US008323935B2

(12) United States Patent
Xue et al.

(10) Patent No.: US 8,323,935 B2
(45) Date of Patent: Dec. 4, 2012

(54) **OPTIMIZED STRAINS OF *YARROWIA LIPOLYTICA* FOR HIGH EICOSAPENTAENOIC ACID PRODUCTION**

(75) Inventors: Zhixiong Xue, Chadds Ford, PA (US); Narendra S. Yadav, Chadds Ford, PA (US); Quinn Qun Zhu, West Chester, PA (US)

(73) Assignee: E I du Pont de Nemours and Company, Wilmington, DE (US)

( * ) Notice: Subject to any disclaimer, the term of this patent is extended or adjusted under 35 U.S.C. 154(b) by 952 days.

(21) Appl. No.: 12/244,822

(22) Filed: Oct. 3, 2008

(65) Prior Publication Data

US 2009/0093543 A1   Apr. 9, 2009

Related U.S. Application Data

(60) Provisional application No. 60/977,177, filed on Oct. 3, 2007, provisional application No. 60/977,174, filed on Oct. 3, 2007.

(51) Int. Cl.
*C12P 7/64* (2006.01)
*C07D 293/10* (2006.01)

(52) U.S. Cl. ........................................... 435/134; 554/1
(58) Field of Classification Search ........................ None
See application file for complete search history.

(56) References Cited

U.S. PATENT DOCUMENTS

| | | | |
|---|---|---|---|
| 5,244,921 | A | 9/1993 | Kyle et al. |
| 5,246,841 | A | 9/1993 | Yazawa et al. |
| 5,246,842 | A | 9/1993 | O'Brien et al. |
| 5,401,646 | A | 3/1995 | Shinmen et al. |
| 6,136,574 | A | 10/2000 | Knutzon et al. |
| 6,331,568 | B1 | 12/2001 | Horrobin |
| 6,624,195 | B2 | 9/2003 | Horrobin |
| 6,825,017 | B1 | 11/2004 | Browse et al. |
| 7,125,672 | B2 | 10/2006 | Picataggio et al. |
| 7,238,482 | B2 | 7/2007 | Picataggio et al. |
| 7,335,476 | B2 | 2/2008 | Picataggio et al. |
| 7,410,663 | B2 | 8/2008 | Koike et al. |
| 2004/0247693 | A1 | 12/2004 | Carpentier et al. |
| 2006/0115881 | A1 | 6/2006 | Damude et al. |
| 2007/0004016 | A1 | 1/2007 | Picataggio et al. |
| 2007/0118929 | A1 | 5/2007 | Damude et al. |
| 2007/0207528 | A1 | 9/2007 | Picataggio et al. |
| 2007/0225370 | A1 | 9/2007 | Opheim |
| 2008/0118623 | A1 | 5/2008 | Damude et al. |
| 2008/0254191 | A1 | 10/2008 | Damude et al. |

FOREIGN PATENT DOCUMENTS

| | | |
|---|---|---|
| EP | 1544281 A1 | 6/2005 |
| WO | 03009828 A1 | 2/2003 |
| WO | 20070127381 A1 | 11/2007 |

OTHER PUBLICATIONS

J. McColl, Health Benefits of Omega-3 Fatty Acids, Nutracos, 2003, vol. 2:35-40.
A. Sinclair et al., The Effects of Eicosapentaenoic Acid in Various Clinical Conditions, Healthful Lipids, 2005, Chapter 16, pp. 360-394.
B. Qi et al., Production of Very Long Chain Polyunsaturated Omega-3 and Omega-6 Fatty Acids in Plants, Nature Biotech., 2004, vol. 22:739-745.
J. M. Dyer et al., Metabolic Engineering of *Saccharomyces cerevisiae* for Production of Novel Lipid Compounds, Appl. Env. Microbiol., 2002, vol. 59:224-230.
F. Domergue et al., Cloning and Functional Characterization of *Phaeodactylum tricornutum* Front-End Desaturases Involved in Eicosapentaenoic Aicid Biosynthesis, Eur. J. Biochem., 2002, vol. 269:4105-4113.
Thomas Juretzek et al., Vectors for Gene Expression and Amplification in the Yeast *Yarrowia lipolytica*, Yeast, 2001, vol. 18:97-113, John Wiley & Sons.
Olga V. Sayanova et al., Eicosapentaenoic Acid: Biosynthetic Routes and the Potential for Synthesis in Transgenic Plants, Phytochemistry, 2004, vol. 65:147-158, Elsevier Ltd.
Douglas H. Hobbs et al., Cloning of a CDNA Encoding Diacylglycerol Acyltransferase From *Arabidopsis thaliana* and Its Functional Expression, FEBS Letter, 1999, vol. 452:145-149, Federal of European Biochemical Societies.
Zheng et al., Characterization and Comparison of Fatty Acyl Delta6 Desaturases CDNAs From Freshwater and Marine Teleost Fish Species, Comp Biochem. Physiol. B Biochem. Mol. Biol., 2004, vol. 139:269-279.
Tsuneo Yamane et al., Production of n-3 Polyunsaturated Fatty Acid-Enriched Fish Oil by Lipase-Catalyzed Acidolysis Without Solvent, Journal of the American Oil Chemists Society, Nov. 1992, pp. 1104-1107, vol. 69, No. 11.
A. Robles Medina et al., Lipase-Catalyzed Esterification of Glycerol and Polyunsaturated Fatty Acids From Fish and Microalgae Oils, Journal of Biotechnology, 1999, pp. 379-391, vol. 70.
Baoxiu Qi et al., Identification of a CDNA Encoding a Novel C18-Delta9 Polyunsaturated Fatty Acid-Specific Elongating Activity From the Docosahexaenoic Acid (DHA)-Producing Microalga, *Isochrysis galbana*, FEBS Letters, vol. 510:159-165, 2002.
James G. Wallis et al., The Delta8-Desaturase of *Euglena gracilis*: An Alternate Pathway for Synthesis of 20-Carbon Polyunsaturated Fatty Acids, Archives of Biochemistry and Biophysics, vol. 365(2):307-316, 1999.
Casimir C. Akoh et al., Healthful Lipids, AOCS: Champaign, IL, 2005; Chapters 14-16.
International Search Report Dated Feb. 19, 2009, International Application No. PCT/US2008/078642.

*Primary Examiner* — Michele K Joike

(57) ABSTRACT

Engineered strains of the oleaginous yeast *Yarrowia lipolytica* capable of producing greater than 50 weight percent of eicosapentaenoic acid ["EPA"], an ω-3 polyunsaturated fatty acid, in the total oil fraction are described. These strains over-express heterologous Δ9 elongases, Δ8 desaturases, Δ5 desaturases, Δ17 desaturases, Δ12 desaturases and $C_{16/18}$ elongases, and optionally over-express diacylglycerol cholinephosphotransferases. Preferred gene knockouts are described, as are methods for producing EPA within the host cells and products comprising EPA from the optimized *Yarrowia lipolytica* strains.

4 Claims, 13 Drawing Sheets

FIG. 2A

Figure 1A:
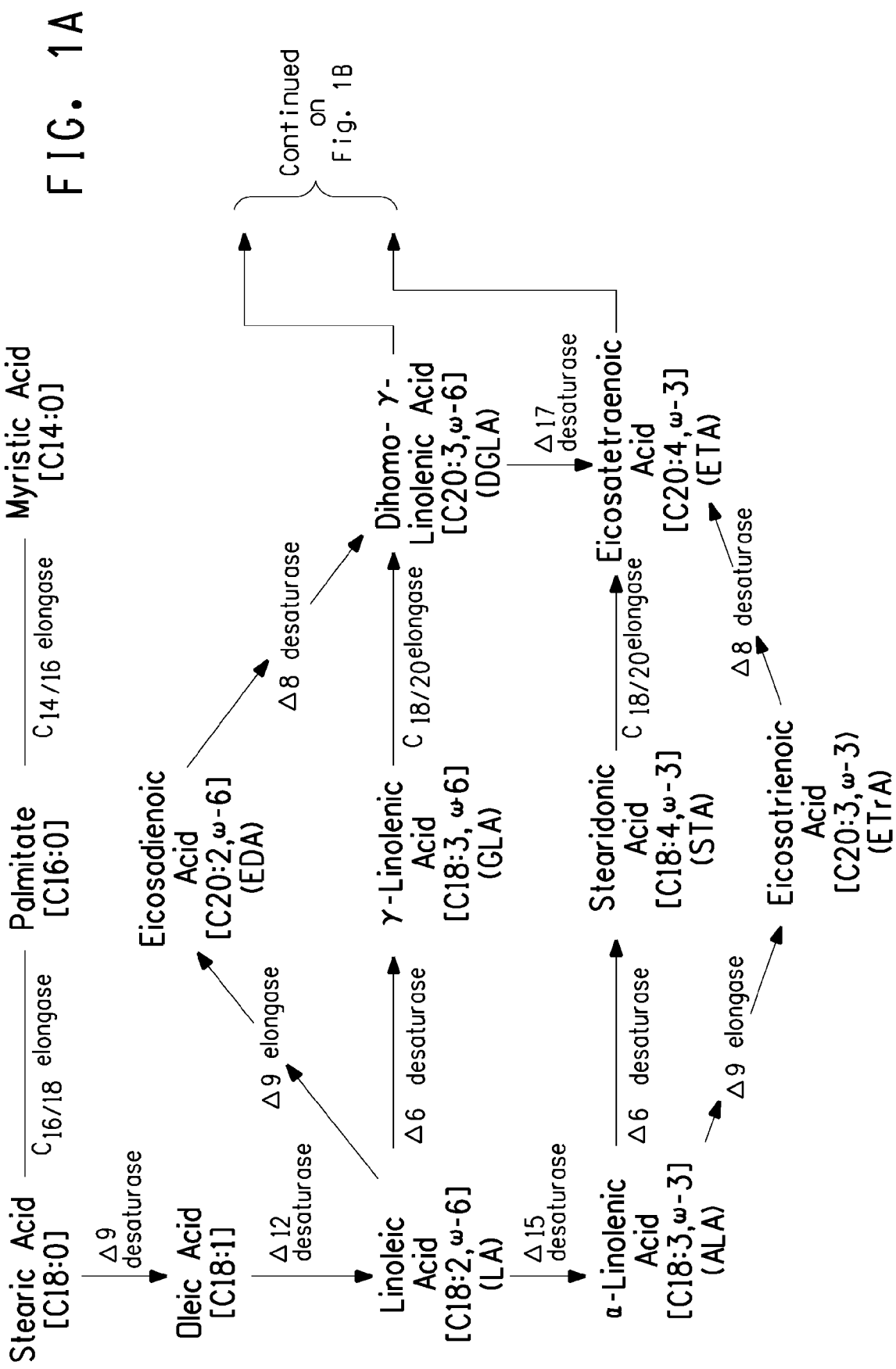

```
327 C T L C L S - - - - - - - - - - - - -     (AA 327-364 of SEQ ID NO:104 [YlPex10p])
266 C A I C F R D E E Q E G G G G A S H Y S T  (AA 266-323 of SEQ ID NO:96 [YlPex2p])
342 C P L C S K - - - - - - - - - - - - -     (AA 342-391 of SEQ ID NO:105 [YlPex12p])
     *    *

333 Y I S A P A C T P C G H F F C W D C I S E W  (AA 327-364 of SEQ ID NO:104 [YlPex10p])
288 D V T M P Y Q A D C G H V Y C Y V C L V T K  (AA 266-323 of SEQ ID NO:96 [YlPex2p])
348 E L V M P T V I E S G Y V E C Y T C I Y R H  (AA 342-391 of SEQ ID NO:105 [YlPex12p])
            *         *         *         *

355 V R E K P E - - - - - - C P L - - - C - -   (AA 327-364 of SEQ ID NO:104 [YlPex10p])
310 L A Q G D G D - G W N C Y R - - - C - -     (AA 266-323 of SEQ ID NO:96 [YlPex2p])
370 L E D G D E T G R C P V T G Q K L L G C     (AA 342-391 of SEQ ID NO:105 [YlPex12p])
```

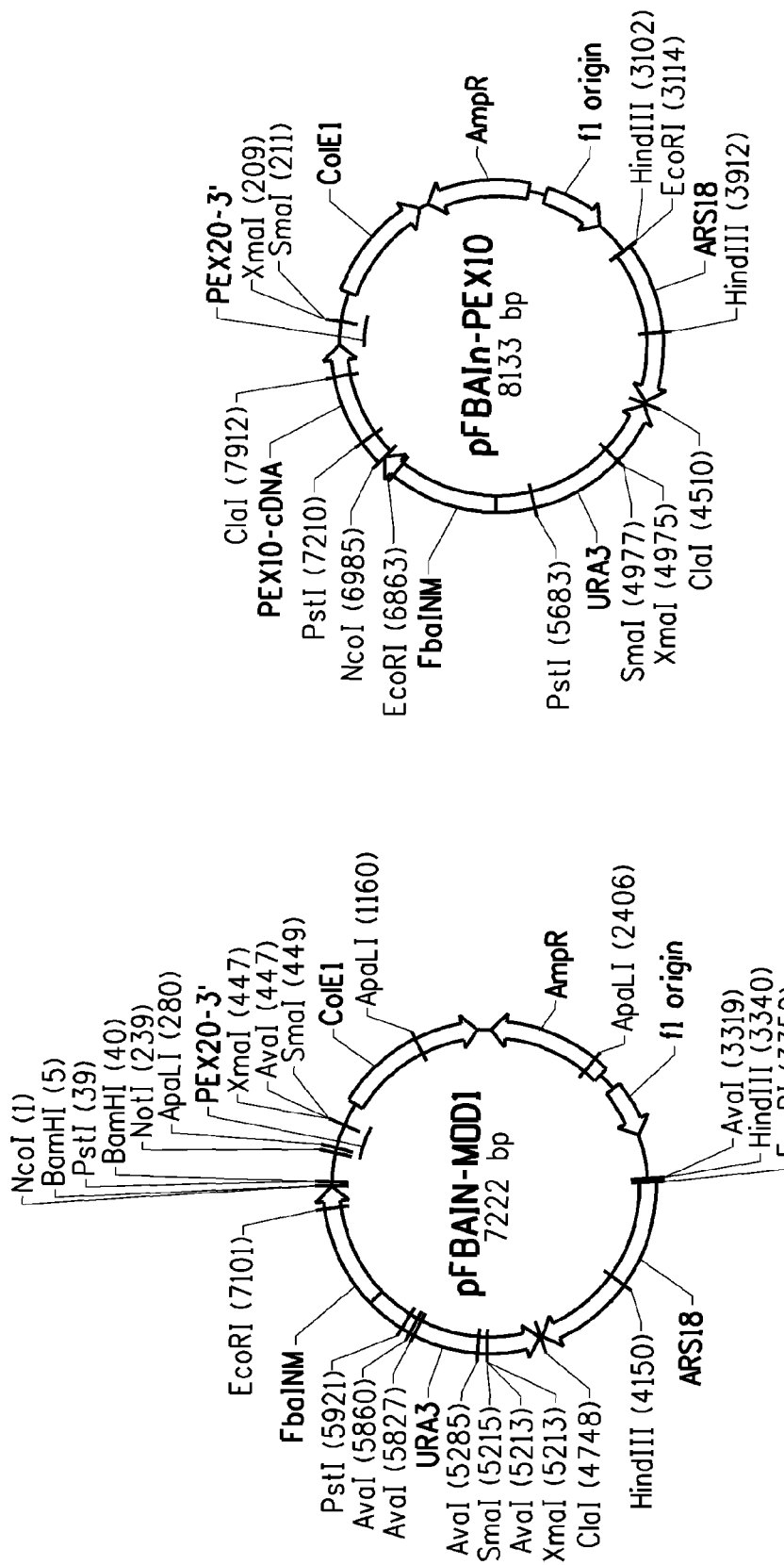

US 8,323,935 B2

OPTIMIZED STRAINS OF *YARROWIA LIPOLYTICA* FOR HIGH EICOSAPENTAENOIC ACID PRODUCTION

This application claims the benefit of U.S. Provisional Applications No. 60/977,174 and No. 60/977,177, both filed Oct. 3, 2007, which are herein incorporated by reference in their entirety.

FIELD OF THE INVENTION

This invention is in the field of biotechnology. More specifically, this invention pertains to an engineered strain of the oleaginous yeast *Yarrowia lipolytica* that is capable of efficiently producing eicosapentaenoic acid, an ω-3 polyunsaturated fatty acid, in high concentrations.

BACKGROUND OF THE INVENTION

Eicosapentaenoic acid ("EPA"; cis-5,8,11,14,17-eicosapentaenoic acid; ω-3) is an important intermediate in the biosynthesis of biologically active prostaglandin. Additionally, EPA is recognized as having clinical and pharmaceutical value. For example, the following pharmacological actions of EPA are known: 1) platelet coagulation inhibitory action (thrombolytic action); 2) blood neutral fat-lowering action; 3) actions for lowering blood VLDL-cholesterol and LDL-cholesterol and increasing HDL-cholesterol (anti-arterial sclerosis action); 4) blood viscosity-lowering action; 5) blood pressure lowering action; 6) anti-inflammatory action; and, 7) anti-tumor action. As such, EPA provides a natural approach to lower blood cholesterol and triglycerides. Increased intake of EPA has been shown to be beneficial or have a positive effect in coronary heart disease, high blood pressure, inflammatory disorders (e.g., rheumatoid arthritis), lung and kidney diseases, Type II diabetes, obesity, ulcerative colitis, Crohn's disease, anorexia nervosa, burns, osteoarthritis, osteoporosis, attention deficit/hyperactivity disorder, and early stages of colorectal cancer. See, for example, the review of McColl, J., *NutraCos*, 2(4):35-40 (2003); Sinclair, A., et al. In *Healthful Lipids*; C. C. Akoh and O.-M. Lai, Eds; AOCS: Champaign, Ill., 2005; Chapter 16. Recent findings have also confirmed the use of EPA in the treatment of mental disorders, such as schizophrenia (U.S. Pat. No. 6,331,568; U.S. Pat. No. 6,624,195). Lastly, EPA is also used in products relating to functional foods (nutraceuticals), infant nutrition, bulk nutrition, cosmetics and animal health.

Microbial production of EPA using recombinant means is expected to have several advantages over production from natural microbial sources (e.g., heterotrophic diatoms *Cyclotella* sp. and *Nitzschia* sp.; *Pseudomonas, Alteromonas* or *Shewanella* species; filamentous fungi of the genus *Pythium*; or *Mortierella elongate, M. exigua,* or *M. hygrophila*) or isolation from fish oil and marine plankton. For example, recombinant microbes having preferred characteristics for oil production can be used, since the naturally occurring microbial fatty acid profile of the host can be altered by the introduction of new biosynthetic pathways in the host and/or by the suppression of undesired pathways. This results in increased levels of production of desired polyunsaturated fatty acids ["PUFAs"], or conjugated forms thereof, and decreased production of undesired PUFAs. Secondly, recombinant microbes can provide PUFAs in particular forms which may have specific uses. Additionally, microbial oil production can be manipulated by controlling culture conditions, notably by providing particular substrate sources for microbially expressed enzymes, or by addition of compounds/genetic engineering to suppress undesired biochemical pathways. Thus, for example, it is possible to modify the ratio of ω-3 to ω-6 fatty acids so produced, or engineer production of a specific PUFA (e.g., EPA) without significant accumulation of other downstream or upstream PUFA products. Production of EPA in recombinant microbes also avoids use of non-substainable oceanic sources, which can suffer from objectionable flavors and contaminants that are difficult and cost-prohibitive to remove. The resulting EPA oil isolated from fermentated recombinant microbes obviates the need for purification of these bioaccumulative compounds.

The literature reports a number of recent examples whereby various portions of the ω-3/ω-6 PUFA biosynthetic pathway, responsible for EPA production, have been introduced into plants (e.g., Qi, B. et al., *Nature Biotech.*, 22:739-745 (2004)) and *Saccharomyces cerevisiae* (a non-oleaginous yeast) (see, Dyer, J. M. et al., *Appl. Env. Microbiol.*, 59:224-230 (2002); U.S. Pat. No. 6,136,574; Domergue, F. et al., *Eur. J. Biochem.*, 269:4105-4113 (2002)).

*Yarrowia lipolytica* has a number of characteristics that make it particularly useful for the production of PUFAs (see for example commonly owned U.S. Pat. No. 7,238,482). Oleaginous yeast are defined as those yeast that are naturally capable of oil synthesis and accumulation, wherein oil accumulation is at least 25% of the cellular dry weight. Commercial production of EPA will require a strain that produces high amounts of EPA as a weight percent of the total fatty acids. Applicants have solved the stated problem by engineering highly optimized strains of *Yarrowia lipolytica* that are capable of producing greater than 53.2% EPA in the total oil fraction.

SUMMARY OF THE INVENTION

The present invention provides a production host for the synthesis of EPA in microbial oil. The strain is a recombinant *Yarrowia* sp. incorporating a number of genetic elements and modifications within its genome that make it uniquely attractive for EPA production.

Accordingly the invention provides a recombinant *Yarrowia* sp. production host cell for the production of eicosapentaenoic acid comprising:

a) at least one gene encoding Δ9 elongase having an amino acid sequence selected from the group consisting of SEQ ID NOs:5, 7, 9, 11, 13, 15 and 17;

b) at least one gene encoding Δ8 desaturase having an amino acid sequence selected from the group consisting of SEQ ID NOs:19, 21, 23, 25, 27, 29, 31 and 33; and wherein the *Yarrowia* sp. production host cell produces at least about 43.3 weight percent of eicosapentaenoic acid measured as a weight percent of the total fatty acids in the production host cell.

In another embodiment the invention provides a method for the production of a microbial oil comprising eicosapentaenoic acid comprising:

a) culturing the production host of the invention wherein a microbial oil comprising eicosapentaenoic acid is produced; and, b) optionally recovering the microbial oil of step (a).

In another embodiment the invention provides microbial oil compositions having at least about 25 weight percent of eicosapentaenoic acid as a weight percent of the total fatty acids, or alternatively having at least about 30 weight percent of eicosapentaenoic acid and less than about 25 weight percent of linoleic acid, as a weight percent of the total fatty acids, or alternatively having at least about 50 weight percent of ω-3 polyunsaturated fatty acids as a weight percent of the total fatty acids.

In an alternate embodiment the invention provides a microbial oil having the following fatty acids concentrations as a weight percent of the total fatty acids:

a) from about 48 to about 55 weight percent of eicosapentaenoic acid;
b) from about 1.5 to about 3.0 weight percent of eicosatetraenoic acid;
c) from about 0.1 to 0.7 weight percent of arachidonic acid;
d) from about 1.0 to about 2.5 weight percent of dihomo-γ-linolenic acid;
e) from about 2.0 to about 3.5 weight percent of eicosadienoic acid;
f) from about 2.0 to about 3.0 weight percent of α-linolenic acid;
g) from about 17.0 to about 20.0 weight percent of linoleic acid (18:2);
h) from about 3.5 to about 6.5 weight percent of oleic acid (18:1);
i) from about 1.0 to about 2.0 weight percent of stearic acid (18:0);
j) from about 0.5 to about 3.5 weight percent of palmitoleic (16:1); and
k) from about 2.5 to about 4.5 weight percent of palmitic acid (16:0).

In another embodiment the microbial oil of the invention having the following fatty acid concentrations as a weight percent of the total fatty acids:

a) at least about 43.3 weight percent of eicosapentaenoic acid;
b) less than about 23.6 weight percent of linoleic acid (18:2); and
c) less than about 9.4 weight percent of oleic acid (18:1).

BIOLOGICAL DEPOSITS

The following biological materials have been deposited with the American Type Culture Collection (ATCC), 10801 University Boulevard, Manassas, Va. 20110-2209, and bear the following designations, accession numbers and dates of deposit.

| Biological Material | Accession No. | Date of Deposit |
|---|---|---|
| Yarrowia lipolytica Y4128 | ATCC PTA-8614 | Aug. 23, 2007 |
| Yarrowia lipolytica Y4127 | ATCC PTA-8802 | Nov. 29, 2007 |

The biological materials listed above were deposited under the terms of the Budapest Treaty on the International Recognition of the Deposit of Microorganisms for the Purposes of Patent Procedure. The listed deposit will be maintained in the indicated international depository for at least 30 years and will be made available to the public upon the grant of a patent disclosing it. The availability of a deposit does not constitute a license to practice the subject invention in derogation of patent rights granted by government action.

BRIEF DESCRIPTION OF THE DRAWINGS AND SEQUENCE DESCRIPTIONS

Figure 1B:
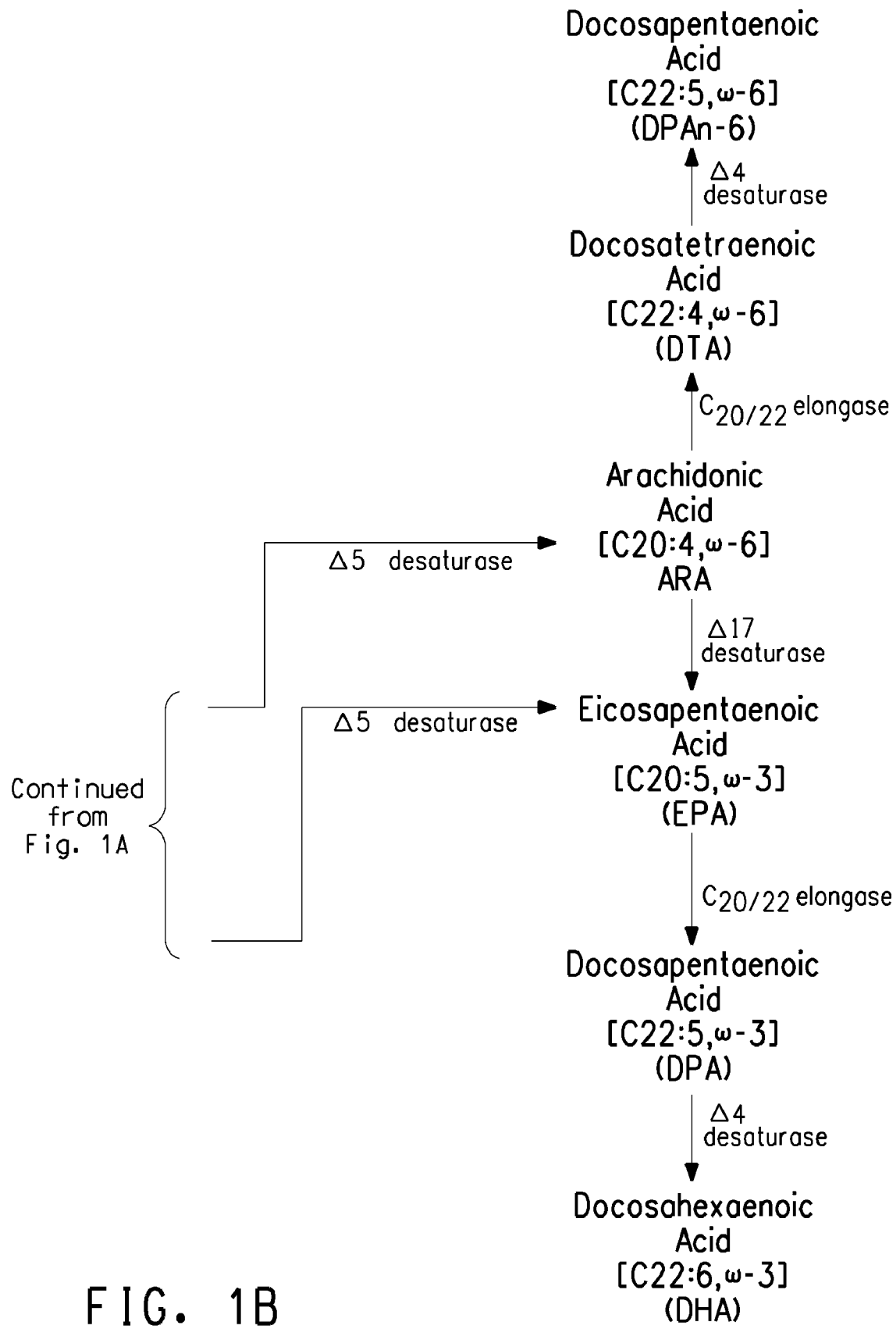

FIG. 1A and FIG. 1B illustrates the ω-3/ω-6 fatty acid biosynthetic pathway, and should be viewed together when considering the description of this pathway below.

Figure 2B:
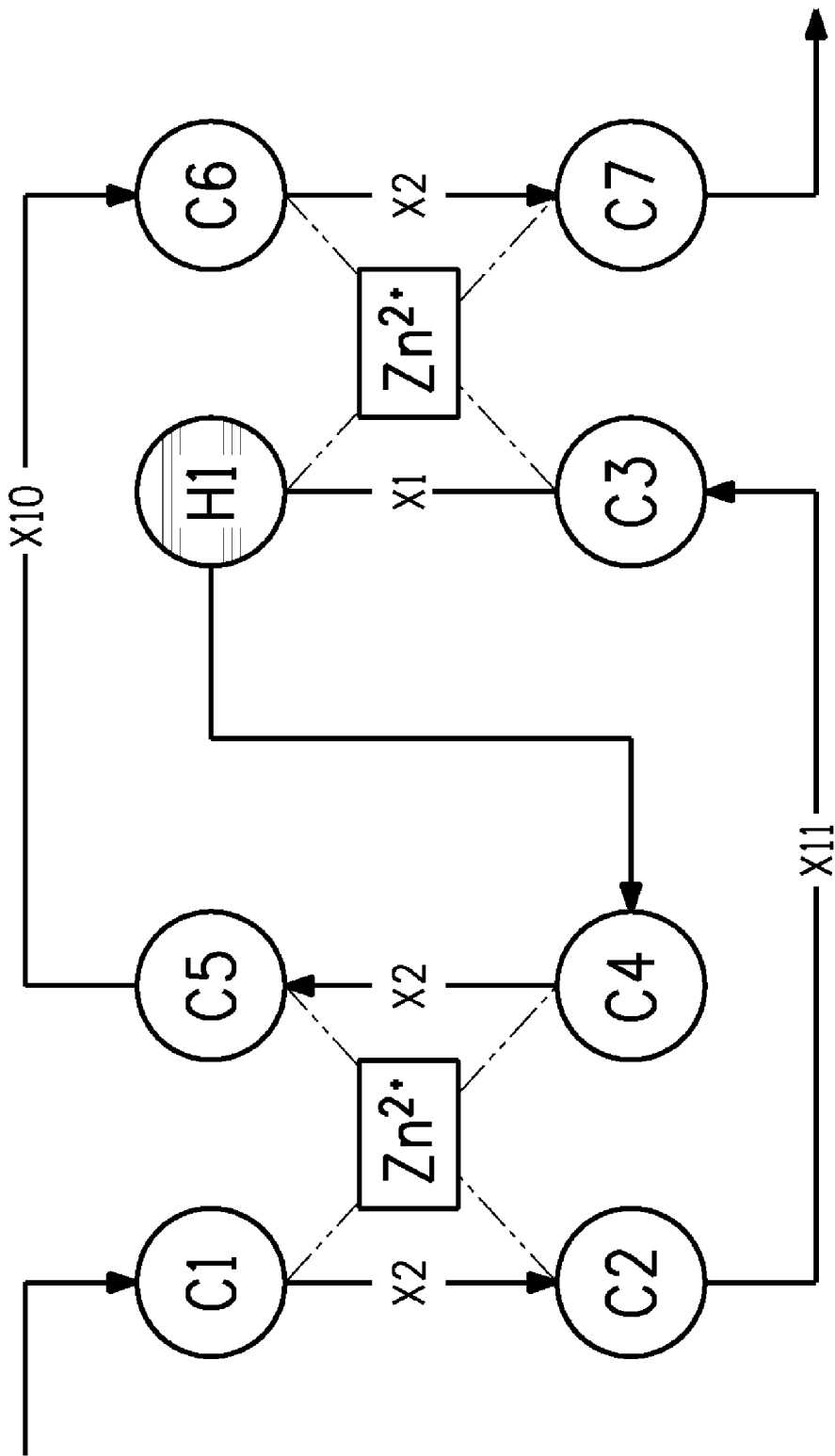

FIG. 2A provides an alignment of the $C_3HC_4$ zinc ring finger motifs of the Yarrowia lipolytica Pex10p (i.e., amino acids 327-364 of SEQ ID NO:104 [GenBank Accession No. CAG81606]), the Yarrowia lipolytica Pex2p (i.e., amino acids 266-323 of SEQ ID NO:96 [GenBank Accession No. CAG77647]) and the Yarrowia lipolytica Pex12p (i.e., amino acids 342-391 of SEQ ID NO:105 [GenBank Accession No. CAG81532]), with cysteine and histidine residues of the conserved $C_3HC_4$ zinc ring finger motif indicated by asterisks. FIG. 2B schematically illustrates the proposed interaction between various amino acid residues of the Y. lipolytica Pex10p $C_3HC_4$ finger motif and the two zinc ions to which they bind.

Figure 3:
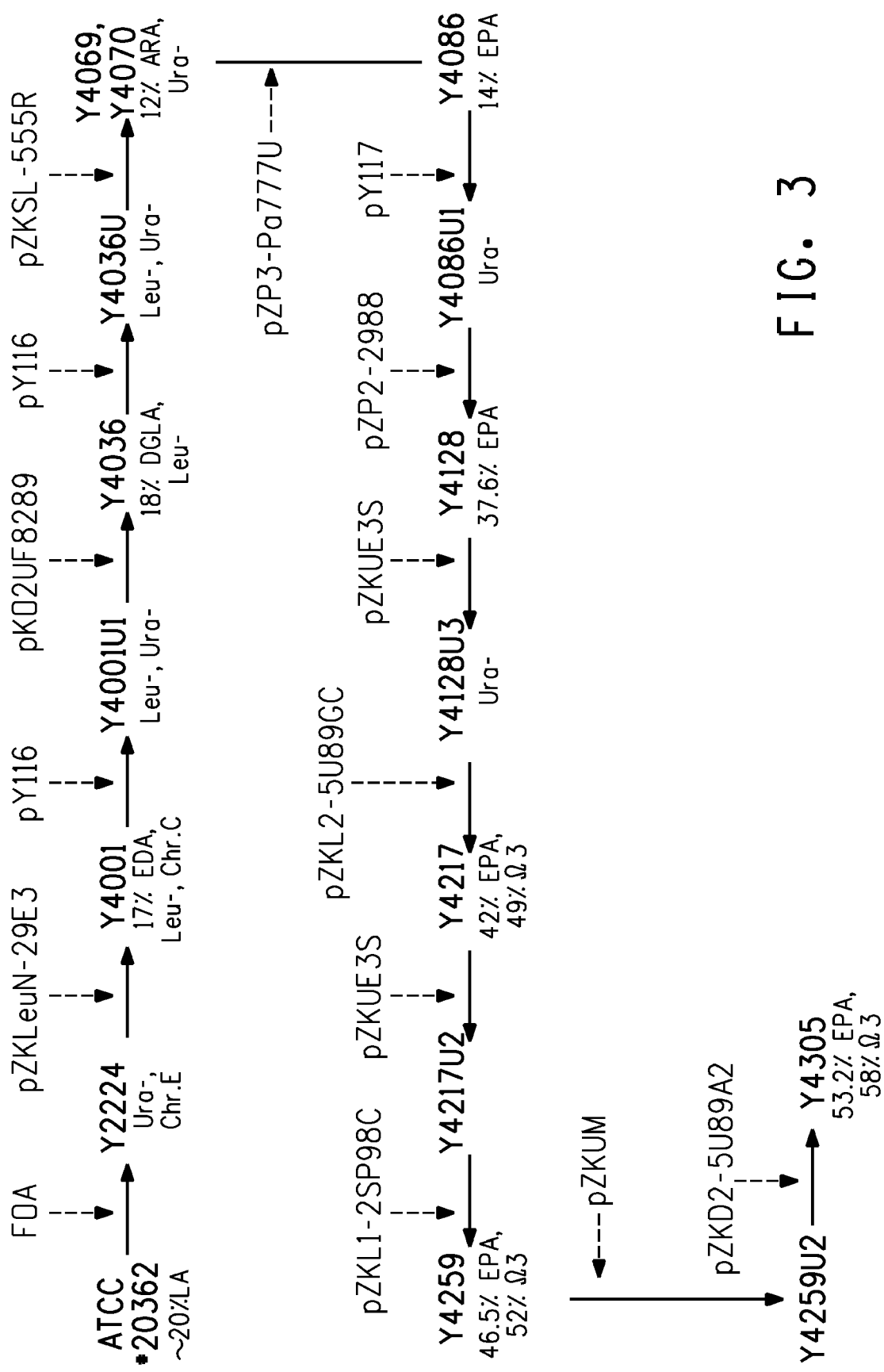

FIG. 3 diagrams the development of Yarrowia lipolytica strain Y4305, producing greater than 53.2% EPA in the total lipid fraction.

Figure 4:
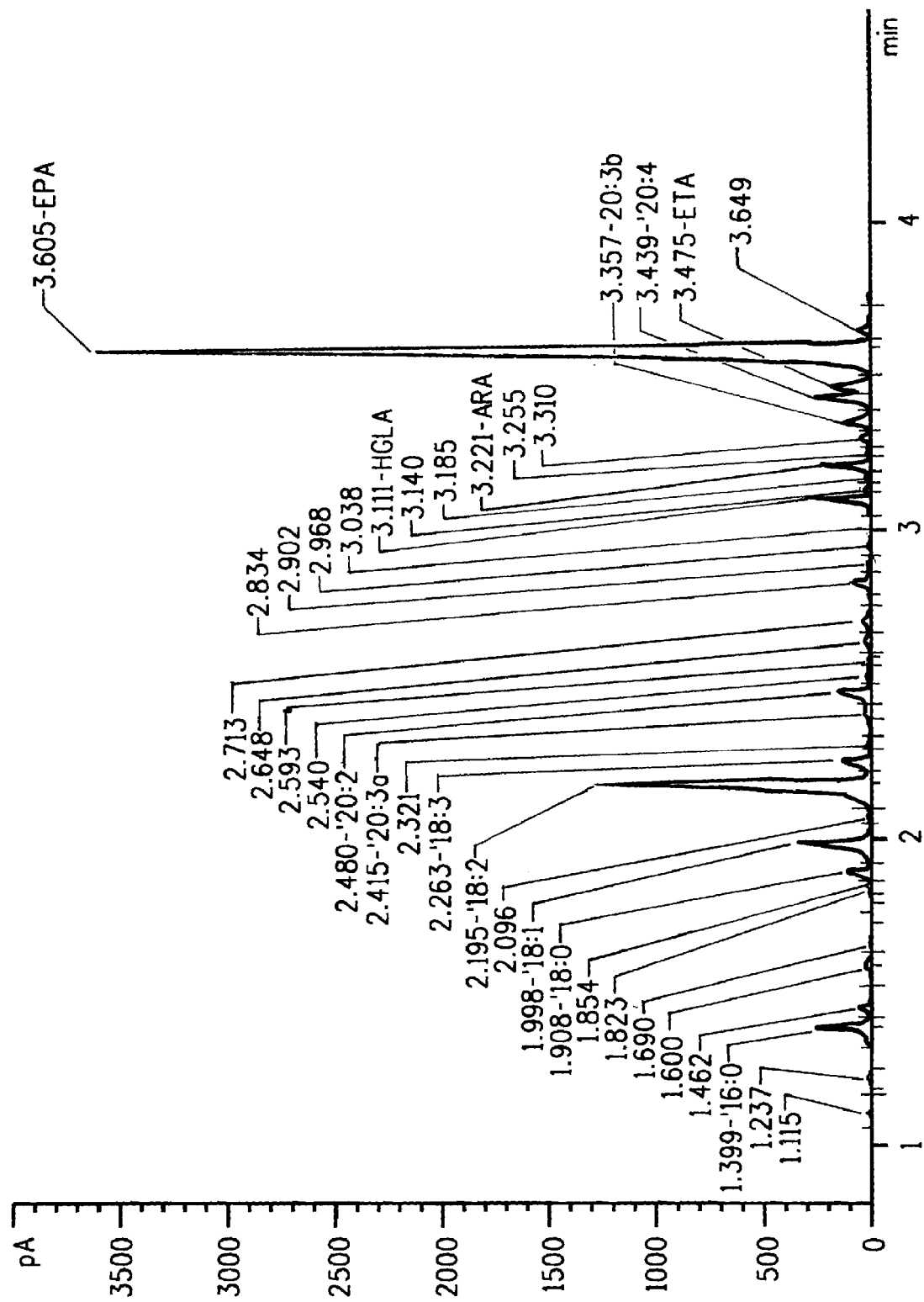

FIG. 4 is a GC chromatograph showing the fatty acid profile in Yarrowia lipolytica strain Y4305 producing 53.2% EPA in the total lipid fraction.

FIG. 5 provides plasmid maps for the following: (A) pZP3-Pa777U; and, (B) pY117.

FIG. 6 provides plasmid maps for the following: (A) pZP2-2988; and, (B) pZKUE3S.

FIG. 7 provides plasmid maps for the following: (A) pZKL2-5U89GC; and, (B) pZKL1-2SP98C.

FIG. 8 provides plasmid maps for the following: (A) pZKUM; and, (B) pZKD2-5U89A2.

FIG. 9 provides plasmid maps for the following: (A) PFBAIN-MOD-1; and, (B) pFBAIN-PEX10.

FIG. 10 provides plasmid maps for the following: (A) pEXP-MOD-1; and, (B) pPEX10-1.

Figure 11A:
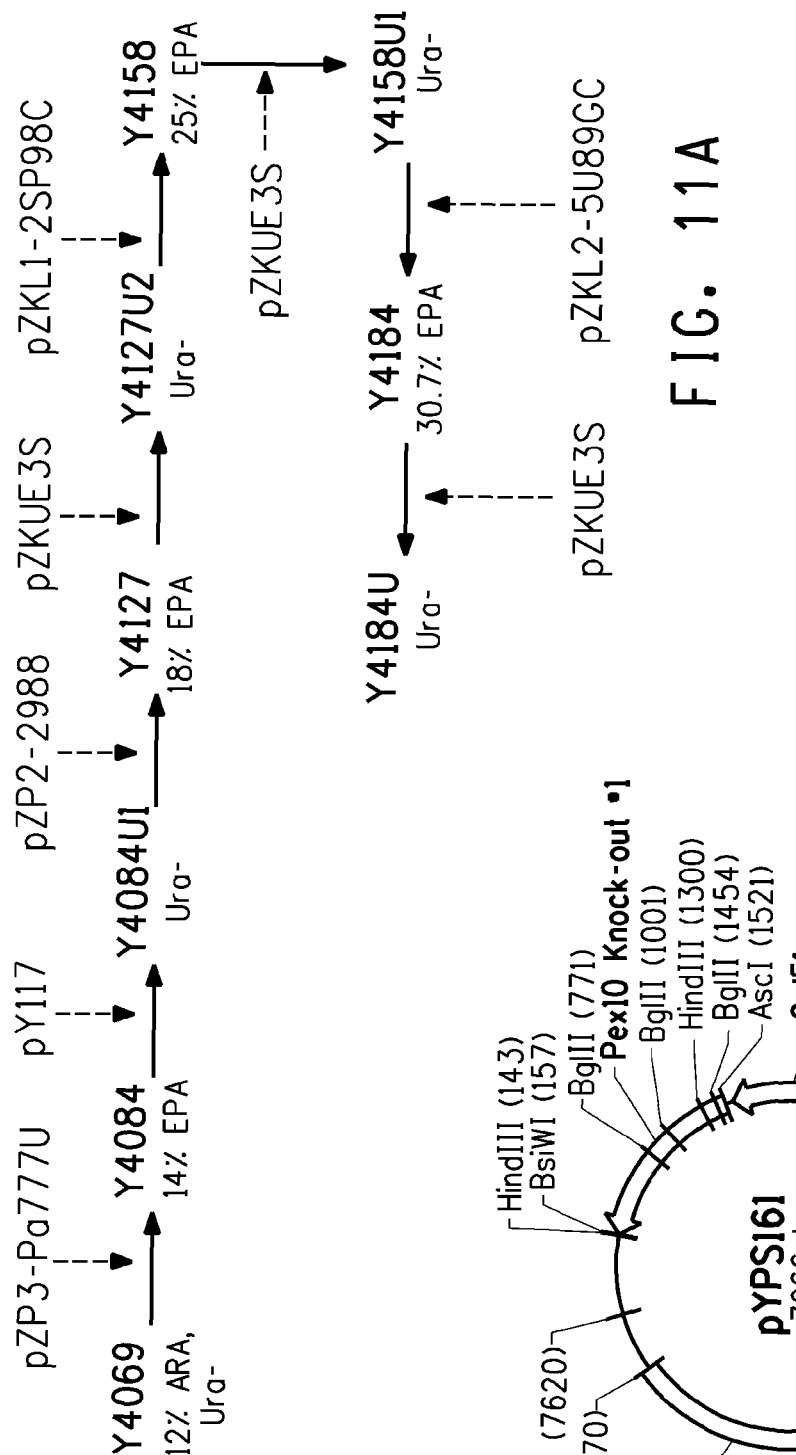
Figure 11B:
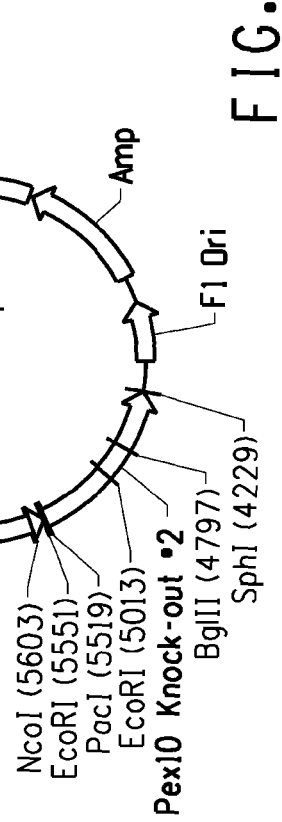

FIG. 11A diagrams the development of Yarrowia lipolytica strain Y4184, producing 30.7% EPA in the total lipid fraction. FIG. 11B provides a plasmid map for pYPS161.

The invention can be more fully understood from the following detailed description and the accompanying sequence descriptions, which form a part of this application.

The following sequences comply with 37 C.F.R. §1.821-1.825 ("Requirements for Patent Applications Containing Nucleotide Sequences and/or Amino Acid Sequence Disclosures—the Sequence Rules") and are consistent with World Intellectual Property Organization (WIPO) Standard ST.25 (1998) and the sequence listing requirements of the EPO and PCT (Rules 5.2 and 49.5(a-bis), and Section 208 and Annex C of the Administrative Instructions). The symbols and format used for nucleotide and amino acid sequence data comply with the rules set forth in 37 C.F.R. §1.822.

SEQ ID NOs:1-135, 150, 151, 155-158, 173-189 and 196-201 are ORFs encoding promoters, genes or proteins (or fragments thereof) or plasmids, as identified in Table 1.

TABLE 1

Summary of Gene and Protein SEQ ID Numbers

| Description | Nucleic acid SEQ ID NO. | Protein SEQ ID NO. |
|---|---|---|
| Yarrowia lipolytica Δ12 desaturase ("YID12") | 1 (1936 bp) | 2 (419 AA) |
| Codon-optimized translation initiation site for genes optimally expressed in Yarrowia sp. | 3 (10 bp) | — |
| Euglena gracilis Δ9 elongase ("EgD9e") | 4 (777 bp) | 5 (258 AA) |
| Synthetic Δ9 elongase derived from Euglena gracilis, codon-optimized for expression in Yarrowia lipolytica ("EgD9eS") | 6 (777 bp) | 7 (258 AA) |
| Eutreptiella sp. CCMP389 Δ9 elongase ("E389D9e") | 8 (792 bp) | 9 (263 AA) |

TABLE 1-continued

Summary of Gene and Protein SEQ ID Numbers

| Description | Nucleic acid SEQ ID NO. | Protein SEQ ID NO. |
|---|---|---|
| Synthetic Δ9 elongase derived from *Eutreptiella* sp. CCMP389 codon-optimized for expression in *Yarrowia lipolytica* ("E389D9eS") | 10 (792 bp) | 11 (263 AA) |
| *Euglena anabaena* UTEX 373 Δ9 elongase (U.S. patent application No. 12/102,879) ("EaD9Elo1") | 12 (774 bp) | 13 (258 AA) |
| Synthetic Δ9 elongase derived from *Euglena anabaena* UTEX 373 (U.S. patent application No. 12/102,879), codon-optimized for expression in *Yarrowia lipolytica* ("EaD9eS") | 14 (774 bp) | 15 (258 AA) |
| *Euglena anabaena* UTEX 373 Δ9 elongase (U.S. patent application No. 12/102,879) ("EaD9Elo2") | 16 (774 bp) | 17 (258 AA) |
| *Euglena gracilis* Δ8 desaturase ("Eg5" or "EgD8") | 18 (1271 bp) | 19 (421 AA) |
| Synthetic Δ8 desaturase derived from *Euglena gracilis*, codon-optimized for expression in *Yarrowia lipolytica* ("D8SF" or "EgD8S") | 20 (1272 bp) | 21 (422 AA) |
| Synthetic mutant Δ8 desaturase ("EgD8M"), derived from *Euglena gracilis* ("EgD8S") (U.S. Pat. No. 7,256,033) | 22 (1272 bp) | 23 (422 AA) |
| *Euglena anabaena* UTEX 373 Δ8 desaturase (U.S. patent application No. 12/099,811) ("EaD8es3") | 24 (1260 bp) | 25 (420 AA) |
| Synthetic Δ8 desaturase derived from *Euglena anabaena* UTEX 373 (U.S. patent application No. 12/099,811), codon-optimized for expression in *Yarrowia lipolytica* ("EaD8S") | 26 (1260 bp) | 27 (420 AA) |
| *Euglena anabaena* UTEX 373 Δ8 desaturase (U.S. Patent Application No. 12/099811) ("EaD8es1") | 28 (1260 bp) | 29 (420 AA) |
| *Euglena anabaena* UTEX 373 Δ8 desaturase (U.S. patent application No. 12/099,811) ("EaD8es2") | 30 (1260 bp) | 31 (420 AA) |
| *Euglena anabaena* UTEX 373 Δ8 desaturase (U.S. patent application No. 12/099,811) ("EaD8es4") | 32 (1260 bp) | 33 (420 AA) |
| *Euglena gracilis* Δ5 desaturase ("EgD5") | 34 (1350 bp) | 35 (449 AA) |
| Synthetic Δ5 desaturase derived from *Euglena gracilis*, codon-optimized for expression in *Yarrowia lipolytica* ("EgD5S") | 36 (1350 bp) | 37 (449 AA) |
| *Peridinium* sp. CCMP626 Δ5 desaturase ("RD5") | 38 (1392 bp) | 39 (463 AA) |
| Synthetic Δ5 desaturase derived from *Peridinium* sp. CCMP626, codon-optimized for expression in *Yarrowia lipolytica* ("RD5S") | 40 (1392 bp) | 41 (463 AA) |
| *Euglena anabaena* UTEX 373 Δ5 desaturase (U.S. patent application No. 12/111,237) ("EaD5Des1") | 42 (1362 bp) | 43 (454 AA) |
| Synthetic Δ5 desaturase derived from *Euglena anabaena* UTEX 373 (U.S. patent application No. 12/111,237), codon-optimized for expression in *Yarrowia lipolytica* ("EaD5S") | 44 (1362 bp) | 45 (454 AA) |
| Synthetic mutant Δ5 desaturase ("EgD5S-HXGG", comprising either a HGGG or a HHGG motif), derived from *Euglena gracilis* ("EgD5S") (U.S. Provisional patent application No. 61/098,333) | — | 122 (449 AA) |
| Synthetic mutant Δ5 desaturase ("EgD5S-HPGS", comprising a HPGS motif), derived from *Euglena gracilis* ("EgD5S") (U.S. Provisional patent application No. 61/098,333) | — | 124 (449 AA) |
| Synthetic mutant Δ5 desaturase ("EaD5S-HCGG", comprising a HCGG motif), derived from *Euglena anabaena* UTEX 373 ("EaD5S") (U.S. Provisional patent application No. 61/098,333) | — | 125 (454 AA) |
| Synthetic mutant Δ5 desaturase ("RD5S-HXGG", comprising either a HCGG or a HWGG motif), derived from *Peridinium* sp. CCMP626 ("RD5S") (U.S. Provisional patent application No. 61/098,333) | — | 126 (463 AA) |
| *Phytophthora ramorum* Δ17 desaturase ("PrD17") | 46 (1086 bp) | 47 (361 AA) |
| Synthetic Δ17 desaturase derived from *Phytophthora ramorum*, codon-optimized for expression in *Yarrowia lipolytica* ("PrD17S") | 48 (1086 bp) | 49 (361 AA) |
| *Pythium aphanidermatum* Δ17 desaturase ("PaD17") | 50 (1080 bp) | 51 (359 AA) |
| Synthetic Δ17 desaturase derived from *Pythium aphanidermatum*, codon-optimized for expression in *Yarrowia lipolytica* ("PaD17S") | 52 (1080 bp) | 53 (359 AA) |
| *Fusarium moniliforme* Δ12 desaturase ("FmD12") | 54 (1434 bp) | 55 (477 AA) |
| Synthetic Δ12 desaturase derived from *Fusarium moniliforme*, codon-optimized for expression in *Yarrowia lipolytica* ("FmD12S") | 56 (1434 bp) | 57 (477 AA) |
| *Mortierella alpina* $C_{16/18}$ elongase | 58 (828 bp) | 59 (275 AA) |
| Synthetic $C_{16/18}$ elongase derived from *Mortierella alpina* ELO3, codon-optimized for expression in *Yarrowia lipolytica* ("ME3S") | 60 (828 bp) | 61 (275 AA) |
| *Fusarium moniliforme* Δ15 desaturase ("FmD15") | 62 (1209 bp) | 63 (402 AA) |
| Synthetic Δ15 desaturase derived from *Fusarium moniliforme*, codon-optimized for expression in *Yarrowia lipolytica* ("FmD15S") | 64 (1209 bp) | 65 (402 AA) |
| *Yarrowia lipolytica* Δ9 desaturase ("YlD9") | 66 (1449 bp) | 67 (482 AA) |
| *Yarrowia lipolytica* diacylglycerol cholinephosphotransferase gene ("YlCPT1") | 68 (1185 bp) | 69 (394 AA) |
| *Yarrowia lipolytica* Ura3 (GenBank Accession No. AJ306421) | 70 (4844 bp) | 71 (284 AA) |
| *Yarrowia lipolytica* Leu2 (GenBank Accession No. AF260230) | 72 (5194 bp) | 73 (405 AA) |
| *Yarrowia lipolytica* Lys5 (GenBank Accession No. M34929) | 74 (2569 bp) | — |
| *Yarrowia lipolytica* Pox1 (GenBank Accession No. XP_504703) | — | 75 (677 AA) |
| *Yarrowia lipolytica* Pox2 (GenBank Accession No. XP_505264) | — | 76 (700 AA) |
| *Yarrowia lipolytica* Pox3 (GenBank Accession No. XP_503244) | — | 77 (700 AA) |
| *Yarrowia lipolytica* Pox4 (GenBank Accession No. XP_504475) | — | 78 (701 AA) |
| *Yarrowia lipolytica* Pox5 (GenBank Accession No. XP_502199) | — | 79 (699 AA) |
| *Yarrowia lipolytica* Lip1 (GenBank Accession No. Z50020) | 80 (3278 bp) | 81 (486 AA) |
| *Yarrowia lipolytica* Lip2 (GenBank Accession No. AJ012632) | 82 (5304 bp) | 83 (334 AA) |
| *Yarrowia lipolytica* Lip3 (GenBank Accession No. AJ249751) | 84 (3630 bp) | 85 (498 AA) |
| *Yarrowia lipolytica* Lip4a (GenBank Accession No. XP_503825) | — | 86 (406 AA) |
| *Yarrowia lipolytica* SCP2 (GenBank Accession No. XM_503410) | 87 (390 bp) | 88 (129 AA) |
| *Yarrowia lipolytica* YALI0C18711g (GenBank Accession No. XM_501987) | 89 (546 bp) | 90 (181 AA) |
| *Yarrowia lipolytica* YALI0F24167g (GenBank Accession No. XM_505819) | 91 (1556 bp) | 92 (351 AA) |
| *Yarrowia lipolytica* diacylglycerol acyltransferase (DGAT2) (U.S. Pat. No. 7,267,976) | 93 (2119 bp) | 94 (514 AA) |
| *Yarrowia lipolytica* Pex1p (GenBank Accession No. CAG82178) | — | 95 (1024 AA) |
| *Yarrowia lipolytica* Pex2p (GenBank | — | 96 |

TABLE 1-continued

Summary of Gene and Protein SEQ ID Numbers

| Description | Nucleic acid SEQ ID NO. | Protein SEQ ID NO. |
|---|---|---|
| Accession No. CAG77647) | | (381 AA) |
| *Yarrowia lipolytica* Pex3p (GenBank Accession No. CAG78565) | — | 97 (431 AA) |
| *Yarrowia lipolytica* Pex3Bp (GenBank Accession No. CAG83356) | — | 98 (395 AA) |
| *Yarrowia lipolytica* Pex4p (GenBank Accession No. CAG79130) | — | 99 (153 AA) |
| *Yarrowia lipolytica* Pex5p (GenBank Accession No. CAG78803) | — | 100 (598 AA) |
| *Yarrowia lipolytica* Pex6p (GenBank Accession No. CAG82306) | — | 101 (1024 AA) |
| *Yarrowia lipolytica* Pex7p (GenBank Accession No. CAG78389) | — | 102 (356 AA) |
| *Yarrowia lipolytica* Pex8p (GenBank Accession No. CAG80447) | — | 103 (671 AA) |
| *Yarrowia lipolytica* Pex10p (GenBank Accession No. CAG81606) | — | 104 (377 AA) |
| *Yarrowia lipolytica* Pex12p (GenBank Accession No. CAG81532) | — | 105 (408 AA) |
| *Yarrowia lipolytica* Pex13p (GenBank Accession No. CAG81789) | — | 106 (412 AA) |
| *Yarrowia lipolytica* Pex14p (GenBank Accession No. CAG79323) | — | 107 (380 AA) |
| *Yarrowia lipolytica* Pex16p (GenBank Accession No. CAG79622) | — | 108 (391 AA) |
| *Yarrowia lipolytica* Pex17p (GenBank Accession No. CAG84025) | — | 109 (225 AA) |
| *Yarrowia lipolytica* Pex19p (GenBank Accession No. AAK84827) | — | 110 (324 AA) |
| *Yarrowia lipolytica* Pex20p (GenBank Accession No. CAG79226) | — | 111 (417 AA) |
| *Yarrowia lipolytica* Pex22p (GenBank Accession No. CAG77876) | — | 112 (195 AA) |
| *Yarrowia lipolytica* Pex26p (GenBank Accession No. NC_006072, antisense translation of nucleotides 117230-118387) | — | 113 (386 AA) |
| Contig comprising *Yarrowia lipolytica* Pex10 gene encoding peroxisomal biogenesis factor protein (Pex10p) (GenBank Accession No. AB036770) | 114 (3387 bp) | — |
| *Yarrowia lipolytica* Pex10 (GenBank Accession No. AB036770, nucleotides 1038-2171) (the protein sequence is 100% identical to SEQ ID NO: 104) | 115 (1134 bp) | 116 (377 AA) |
| *Yarrowia lipolytica* Pex10 (GenBank Accession No. AJ012084, which corresponds to nucleotides 1107-2171 of GenBank Accession No. AB036770) (the first 23 amino acids are truncated with respect to the protein sequences of SEQ ID NOs: 104 and 116) | 117 (1065 bp) | 118 (354 AA) |
| *Yarrowia lipolytica* Pex10p C$_3$HC$_4$ zinc ring finger motif (i.e., amino acids 327-364 of SEQ ID NO: 104) | — | 119 (38 AA) |
| *Yarrowia lipolytica* truncated Pex10p (GenBank Accession No. CAG81606 [SEQ ID NO: 104], with C-terminal 32 amino acid deletion) | — | 120 (345 AA) |
| *Yarrowia lipolytica* mutant acetohydroxyacid synthase (AHAS) gene comprising a W497L mutation | 121 (2987 bp) | |
| *Escherichia coli* LoxP recombination site, recognized by a Cre recombinase enzyme | 123 (34 bp) | — |
| Plasmid pZP3-Pa777U | 127 (13,066 bp) | — |
| Plasmid pY117 | 128 (9570 bp) | — |
| Plasmid pZP2-2988 | 129 (15,743 bp) | — |
| Plasmid pZKUE3S | 130 (6303 bp) | — |
| Plasmid pZKL2-5U89GC | 131 (15,812 bp) | — |
| Plasmid pZKL1-2SP98C | 132 (15,877 bp) | — |
| Plasmid pZKUM | 133 (4313 bp) | — |
| Synthetic mutant Ura3 gene comprising a 33 bp deletion from +21 to +53, a 1 bp deletion at +376 and a 3 bp deletion from +400 to +403 of the *Yarrowia* Ura3 coding region (GenBank Accession No. AJ306421) | 134 (1459 bp) | — |
| Plasmid pZKD2-5U89A2 | 135 (15,966 bp) | — |
| Plasmid pFBAIN-MOD-1 | 150 (7222 bp) | — |
| Plasmid pFBAIn-PEX10 | 151 (8133 bp) | — |
| Plasmid pEXP-MOD1 | 155 (7277 bp) | — |
| Plasmid pPEX10-1 | 156 (7559 bp) | — |
| Plasmid pPEX10-2 | 157 (8051 bp) | — |
| Plasmid pYPS161 | 158 (7966 bp) | — |
| Chimeric fragment: DNA from chromosome E, unknown DNA and 5'-end of pZKD2-5U89A2 | 173 (844 bp) | — |
| Unknown DNA between the 5'-end of pZKD2-5U89A2 and chromosome E | 174 (303 bp) | — |
| Chimeric fragment: chromosome F, unknown DNA and 5'-end of pZP3-PA777U | 175 (2365 bp) | — |
| Unknown DNA between the 5'-end of pZP3-PA777U and chromosome F | 176 (1729 bp) | — |
| Chimeric fragment: chromosome F and 3'-end of the AscI/PacI fragment of pZP3-PA777U | 177 (326 bp) | — |
| Chimeric fragment: chromosome C and the 5'-end of the AscI/SphI fragment of pZKL2-5U89GC | 178 (519 bp) | — |
| Unknown DNA at the junction of chromosome C and 5'-end of the AscI/SphI fragment of pZKL2-5U89GC | 179 (66 bp) | — |
| Fragment containing DNA from chromosome C and the 3'-end of the AscI/SphI fragment of pZKL2-5U89GC | 180 (711 bp) | — |
| Unknown DNA at the junction of chromosome C and the 3'-end of the AscI/SphI fragment of pZKL2-5U89GC | 181 (65 bp) | — |
| HPGG motif | — | 182 |
| HXGG motif | — | 183 |
| HPGX motif | — | 184 |
| HGGG motif | — | 185 |
| HHGG motif | — | 186 |
| HPGS motif | — | 187 |
| HCGG motif | — | 188 |
| HWGG motif | — | 189 |
| Synthetic mutant Δ5 desaturase ("EgD5S-HGGG"), derived from *Euglena gracilis* ("EgD5S") (U.S. Provisional patent application No. 61/098,333) | 196 (1350 bp) | — |
| Synthetic mutant Δ5 desaturase ("EgD5S-HHGG"), derived from *Euglena gracilis* ("EgD5S") (U.S. Provisional patent application No. 61/098,333) | 197 (1350 bp) | — |
| Synthetic mutant Δ5 desaturase ("EgD5S-HPGS"), derived from *Euglena gracilis* ("EgD5S") (U.S. Provisional patent application No. 61/098,333) | 198 (1350 bp) | — |
| Synthetic mutant Δ5 desaturase ("EaD5S-HCGG"), derived from *Euglena anabaena* UTEX 373 ("EaD5S") (U.S. Provisional patent application No. 61/098,333) | 199 (1365 bp) | — |
| Synthetic mutant Δ5 desaturase ("RD5S-HCGG"), derived from *Peridinium* sp. CCMP626 ("RD5S") (U.S. Provisional patent application No. 61/098,333) | 200 (1392 bp) | — |
| Synthetic mutant Δ5 desaturase ("RD5S-HWGG"), derived from *Peridinium* sp. | 201 (1392 bp) | — |

TABLE 1-continued

Summary of Gene and Protein SEQ ID Numbers

| Description | Nucleic acid SEQ ID NO. | Protein SEQ ID NO. |
|---|---|---|
| CCMP626 ("RD5S") (U.S. Provisional patent application No. 61/098,333) | | |

SEQ ID NOs:136-143 correspond to primers pZP-GW-5-1, pZP-GW-5-2, pZP-GW-5-3, pZP-GW-5-4, pZP-GW-3-1, pZP-GW-3-2, pZP-GW-3-3 and pZP-GW-3-4, respectively, used to perform genome walking to determine the genomic integration site of pZP2-2988 in strain Y4128.

SEQ ID NOs:144 and 145 correspond to the Genome Walker adaptor, while SEQ ID NO:146 corresponds to Nested adaptor primer, respectively.

SEQ ID NOs:147 and 148 correspond to primers Per10 F1 and ZPGW-5-5, respectively, used to determine the 5' end of the genomic integration site of pZP2-2988.

SEQ ID NO:149 corresponds to primer Per10 R, used to amplify the coding region of the *Y. lipolytica* Pex10 gene.

SEQ ID NOs:152-154 correspond to primers PEX10-R-BsiWI, PEX10-F1-SalI and PEX10-F2-SalI, respectively, used in the construction of pPEX10-1 and pPEX10-2.

SEQ ID NOs:159 and 160 correspond to primers Pex-10del1 3'. Forward and Pex-10del2 5'. Reverse, respectively, used for identification of cells having a Pex10 deletion.

SEQ ID NOs:161-164 correspond to primers KL2-3-1, KD2-3-2, SCP-5-2 and KD2-5-3, respectively, used to perform genome walking to determine the genomic integration site of pZKD2-5U89A2 in strain Y4305.

SEQ ID NOs:165-168 correspond to primers 79-5-POX-1, 79-5-POX-2, 4305ZP3-3-2 and 79-3-POX-3, respectively, used to perform genome walking to determine the genomic integration site of pZP3-PA777U in strain Y4305.

SEQ ID NOs:169-172 correspond to primers KL2-5-2, KL2-5-3, KL2-3-2 and KL2-3-3, respectively, used to perform genome walking to determine the genomic integration site of pZKL2-5U89GC in strain Y4305.

SEQ ID NOs:190-195 correspond to His-rich motifs that are featured in membrane-bound fatty acid desaturases belonging to a super-family of membrane di-iron proteins.

DETAILED DESCRIPTION OF THE INVENTION

The following patents, patent applications, and publications cited herein are incorporated by reference in their entirety: U.S. patent application Ser. No. 11/265,761 (filed Nov. 2, 2005), U.S. Provisional Application No. 60/977,174 (filed Oct. 3, 2007) and U.S. Provisional Application No. 60/977,177 (filed Oct. 3, 2007).

Described herein are production host strains of *Yarrowia lipolytica* that are capable of producing greater than 25% eicosapentaenoic acid (EPA; 20:5 ω-3). Accumulation of this particular polyunsaturated fatty acid ["PUFA"] is accomplished by introduction of a functional ω-3/ω-6 fatty acid biosynthetic pathway comprising proteins with Δ9 elongase, Δ8 desaturase, Δ5 desaturase, Δ17 desaturase, Δ12 desaturase and $C_{16/18}$ elongase activities, which thereby enables production of an EPA oil that lacks γ-linolenic acid ["GLA"]. Thus, this disclosure demonstrates that *Y. lipolytica* can be engineered to enable commercial production of EPA and derivatives thereof. Methods of production are also claimed.

PUFAs, or derivatives thereof, are used as dietary substitutes, or supplements, particularly infant formulas, for patients undergoing intravenous feeding or for preventing or treating malnutrition. Alternatively, the purified PUFAs (or derivatives thereof) may be incorporated into cooking oils, fats or margarines formulated so that in normal use the recipient would receive the desired amount for dietary supplementation. The PUFAs may also be incorporated into infant formulas, nutritional supplements or other food products and may find use as anti-inflammatory or cholesterol lowering agents. Optionally, the compositions may be used for pharmaceutical use, either human or veterinary.

Supplementation of humans or animals with PUFAs produced by recombinant means can result in increased levels of the added PUFAs, as well as their metabolic progeny. For example, treatment with EPA can result not only in increased levels of EPA, but also downstream products of EPA such as eicosanoids (i.e., prostaglandins, leukotrienes, thromboxanes), docosapentaenoic acid ["DPA"] and docosahexaenoic acid ["DHA"]. Complex regulatory mechanisms can make it desirable to combine various PUFAs, or add different conjugates of PUFAs, in order to prevent, control or overcome such mechanisms to achieve the desired levels of specific PUFAs in an individual.

Alternately, PUFAs, or derivatives thereof, made by the methodology disclosed herein can be utilized in the synthesis of animal and aquaculture feeds, such as dry feeds, semi-moist and wet feeds, since these formulations generally require at least 1-2% of the nutrient composition to be ω-3 and/or ω-6 PUFAs.

DEFINITIONS

In this disclosure, a number of terms and abbreviations are used. The following definitions are provided.

"Open reading frame" is abbreviated as "ORF".

"Polymerase chain reaction" is abbreviated as "PCR".

"American Type Culture Collection" is abbreviated as "ATCC".

"Polyunsaturated fatty acid(s)" is abbreviated as "PUFA(s)".

"Diacylglycerol acyltransferase" is abbreviated as "DAG AT" or "DGAT".

"Triacylglycerols" are abbreviated as "TAGs".

"Co-enzyme A" is abbreviated as "CoA".

"Total fatty acids" are abbreviated as "TFAs".

"Fatty acid methyl esters" are abbreviated as "FAMEs".

"Dry cell weight" is abbreviated as "DCW".

As used herein the term "invention" or "present invention" is intended to refer to all aspects and embodiments of the invention as described in the claims and specification herein and should not be read so as to be limited to any particular embodiment or aspect.

The term "food product" refers to any food generally suitable for human consumption. Typical food products include, but are not limited to: meat products, cereal products, baked foods, snack foods, dairy products, beverages and the like. The terms "food analog", "functional food", "medical food" and "medical nutritional" are defined as in Patent Publication No. US 2006-0115881-A1.

The term "pharmaceutical" as used herein means a compound or substance which if sold in the United States would be controlled by Section 503 or 505 of the Federal Food, Drug and Cosmetic Act.

The term "infant formula" means a food which is designed exclusively for consumption by the human infant by reason of its simulation of human breast milk. Typical commercial examples of infant formula include, but are not limited to: Similac® and Isomil®.

The term "dietary supplement" refers to a product that: (i) is intended to supplement the diet and thus is not represented for use as a conventional food or as a sole item of a meal or the diet; (ii) contains one or more dietary ingredients (including, e.g., vitamins, minerals, herbs or other botanicals, amino acids, enzymes and glandulars) or their constituents; (iii) is intended to be taken by mouth as a pill, capsule, tablet, or liquid; and, (iv) is labeled as being a dietary supplement.

The term "clinical condition" will mean a condition in a human or animal that impairs the health and well being of the human or animal and can be remediated by the supplementation of PUFAs and particularly ω-3 and/or ω-6 fatty acids. Clinical conditions may take the form of well documented disease states such as coronary heart disease or a general condition of poor health brought about by poor nutrient regulation.

The term "animal feed" refers to feeds intended exclusively for consumption by animals, including domestic animals such as pets, farm animals, etc. or for animals raised for the production of food, such as for e.g., fish farming. The terms "aquaculture feed", "aquafeed" and "feed nutrient" are as defined in Patent Publication No. US 2006-0115881-A1.

As used herein the term "biomass" refers specifically to spent or used yeast cellular material from the fermentation of a recombinant production host producing EPA in commercially significant amounts, wherein the preferred production host is a recombinant strain of the oleaginous yeast, *Yarrowia lipolytica*. The biomass may be in the form of whole cells, whole cell lysates, homogenized cells, partially hydrolyzed cellular material, and/or partially purified cellular material (e.g., microbially produced oil).

The term "lipids" refer to any fat-soluble (i.e., lipophilic), naturally-occurring molecule. Lipids are a diverse group of compounds that have many key biological functions, such as structural components of cell membranes, energy storage sources and intermediates in signaling pathways. Lipids may be broadly defined as hydrophobic or amphiphilic small molecules that originate entirely or in part from either ketoacyl or isoprene groups. A general overview of lipids, based on the Lipid Metabolites and Pathways Strategy (LIPID MAPS) classification system (National Institute of General Medical Sciences, Bethesda, Md.), is shown below in Table 2.

TABLE 2

Overview Of Lipid Classes

| Structural Building Block | Lipid Category | Examples Of Lipid Classes |
|---|---|---|
| Derived from condensation of ketoacyl subunits | Fatty Acyls | Includes fatty acids, eicosanoids, fatty esters and fatty amides |
| | Glycerolipids | Includes mainly mono-, di- and tri-substituted glycerols, the most well-known being the fatty acid esters of glycerol ["triacylglycerols"] |
| | Glycero-phospholipids or Phospholipids | Includes phosphatidylcholine, phosphatidylethanolamine, phosphatidylserine, phosphatidylinositols and phosphatidic acids |
| | Sphingolipids | Includes ceramides, phospho-sphingolipids (e.g., sphingomyelins), glycosphingolipids (e.g., gangliosides), sphingosine, cerebrosides |
| | Saccharolipids | Includes acylaminosugars, acylamino-sugar glycans, acyltrehaloses, acyltrehalose glycans |
| | Polyketides | Includes halogenated acetogenins, polyenes, linear tetracyclines, polyether antibiotics, flavonoids, aromatic polyketides |

TABLE 2-continued

Overview Of Lipid Classes

| Structural Building Block | Lipid Category | Examples Of Lipid Classes |
|---|---|---|
| Derived from condensation of isoprene subunits | Sterol Lipids | Includes sterols (e.g., cholesterol), C18 steroids (e.g., estrogens), C19 steroids (e.g., androgens), C21 steroids (e.g., progestogens, glucocorticoids and mineral-ocorticoids), secosteroids, bile acids |
| | Prenol Lipids | Includes isoprenoids, carotenoids, quinones, hydroquinones, polyprenols, hopanoids |

The term "total lipid fraction" of cells herein refers to all esterified fatty acids of the cell. Various subfractions within the total lipid fraction can be isolated, including the triacylglycerol ["oil"] fraction, phosphatidylcholine fraction and the phosphatidyletanolamine fraction, although this is by no means inclusive of all sub-fractions.

"Lipid bodies" refer to lipid droplets that are bound by a monolayer of phospholipid and, usually, by specific proteins. These organelles are sites where most organisms transport/store neutral lipids. Lipid bodies are thought to arise from microdomains of the endoplasmic reticulum that contain TAG biosynthesis enzymes. Their synthesis and size appear to be controlled by specific protein components.

"Neutral lipids" refer to those lipids commonly found in cells in lipid bodies as storage fats and oils and are so called because at cellular pH, the lipids bear no charged groups. Generally, they are completely non-polar with no affinity for water. Neutral lipids generally refer to mono-, di-, and/or triesters of glycerol with fatty acids, also called monoacylglycerol, diacylglycerol or triacylglycerol, respectively, or collectively, acylglycerols. A hydrolysis reaction must occur to release free fatty acids from acylglycerols.

The terms "triacylglycerols" ["TAGs"] and "oil" are interchangeable and refer to neutral lipids composed of three fatty acyl residues esterified to a glycerol molecule. TAGs can contain long chain PUFAs, as well as shorter saturated and unsaturated fatty acids and longer chain saturated fatty acids. The TAG fraction of cells is also referred to as the "oil fraction", and "oil biosynthesis" generically refers to the synthesis of TAGs in the cell. The oil or TAG fraction is a subfraction of the total lipid fraction, although also it constitutes a major part of the total lipid content, measured as the weight of total fatty acids in the cell as a percent of the dry cell weight [see below], in oleaginous organisms. The fatty acid composition in the oil ["TAG"] fraction and the fatty acid composition of the total lipid fraction are generally similar. Thus, an increase or decrease in the concentration of PUFAs in the total lipid fraction will correspond with an increase or decrease in the concentration of PUFAs in the oil ["TAG"] fraction, and vice versa.

The term "phosphatidylcholine" or "PC" refers to a phospholipid that is a major constituent of cell membranes. The chemical structure of PC can generally be described as comprising the following: a choline molecule, a phosphate group and glycerol, wherein fatty acyl chains are attached as R groups on the sn-1 and sn-2 positions of the glycerol molecule.

The term "total fatty acids" ["TFAs"] herein refer to the sum of all cellular fatty acids that can be derivitized to fatty acid methyl esters ["FAMEs"] by the base transesterification method (as known in the art) in a given sample, which may be the total lipid fraction or the oil fraction, for example. Thus, total fatty acids include fatty acids from neutral and polar lipid fractions, including the phosphatidylcholine fraction, the phosphatidyletanolamine fraction and the diacylglycerol, monoacylglycerol and triacylglycerol ["TAG or oil"] fractions but not free fatty acids.

The term "total lipid content" of cells is a measure of TFAs as a percent of the dry cell weight ["DCW"]. Thus, total lipid content ["TFAs % DCW"] is equivalent to, e.g., milligrams of total fatty acids per 100 milligrams of DCW.

Generally, the concentration of a fatty acid is expressed herein as a weight percent of TFAs ["% TFAs"], e.g., milligrams of the given fatty acid per 100 milligrams of TFAs. Unless otherwise specifically stated in the disclosure herein, reference to the percent of a given fatty acid with respect to total lipids is equivalent to concentration of the fatty acid as % TFAs (e.g., % EPA of total lipids is equivalent to EPA % TFAs).

In some cases, it is useful to express the content of a given fatty acid(s) in a cell as its percent of the dry cell weight ["% DCW"]. Thus, for example, eicosapentaenoic acid % DCW would be determined according to the following formula: (eicosapentaenoic acid % TFAs)*(TFA % DCW)]/100.

The terms "lipid profile" and "lipid composition" are interchangeable and refer to the amount of an individual fatty acid contained in a particular lipid fraction, such as in the total lipid fraction or the oil ["TAG"] fraction, wherein the amount is expressed as a percent of TFAs. The sum of each individual fatty acid present in the mixture should be 100.

The term "fatty acids" refers to long chain aliphatic acids (alkanoic acids) of varying chain lengths, from about $C_{12}$ to $C_{22}$, although both longer and shorter chain-length acids are known. The predominant chain lengths are between $C_{16}$ and $C_{22}$. The structure of a fatty acid is represented by a simple notation system of "X:Y", where X is the total number of carbon ["C"] atoms in the particular fatty acid and Y is the number of double bonds. Additional details concerning the differentiation between "saturated fatty acids" versus "unsaturated fatty acids", "monounsaturated fatty acids" versus "polyunsaturated fatty acids" ["PUFAs"], and "omega-6 fatty acids" ["ω-6" or "n-6"] versus "omega-3 fatty acids" ["ω-3" or "n-3"] are provided in U.S. Pat. No. 7,238,482, which is hereby incorporated herein by reference.

Nomenclature used to describe PUFAs herein is given in Table 3. In the column titled "Shorthand Notation", the omega-reference system is used to indicate the number of carbons, the number of double bonds and the position of the double bond closest to the omega carbon, counting from the omega carbon, which is numbered 1 for this purpose. The remainder of the Table summarizes the common names of ω-3 and ω-6 fatty acids and their precursors, the abbreviations that will be used throughout the specification and the chemical name of each compound.

TABLE 3

Nomenclature of Polyunsaturated Fatty Acids And Precursors

| Common Name | Abbreviation | Chemical Name | Shorthand Notation |
|---|---|---|---|
| Myristic | — | tetradecanoic | 14:0 |
| Palmitic | Palmitate | hexadecanoic | 16:0 |
| Palmitoleic | — | 9-hexadecenoic | 16:1 |
| Stearic | — | octadecanoic | 18:0 |
| Oleic | — | cis-9-octadecenoic | 18:1 |
| Linoleic | LA | cis-9,12-octadecadienoic | 18:2 ω-6 |

TABLE 3-continued

Nomenclature of Polyunsaturated Fatty Acids And Precursors

| Common Name | Abbreviation | Chemical Name | Shorthand Notation |
|---|---|---|---|
| γ-Linolenic | GLA | cis-6,9,12-octadecatrienoic | 18:3 ω-6 |
| Eicosadienoic | EDA | cis-11,14-eicosadienoic | 20:2 ω-6 |
| Dihomo-γ-Linolenic | DGLA | cis-8,11,14-eicosatrienoic | 20:3 ω-6 |
| Arachidonic | ARA | cis-5,8,11,14-eicosatetraenoic | 20:4 ω-6 |
| α-Linolenic | ALA | cis-9,12,15-octadecatrienoic | 18:3 ω-3 |
| Stearidonic | STA | cis-6,9,12,15-octadecatetraenoic | 18:4 ω-3 |
| Eicosatrienoic | ETrA | cis-11,14,17-eicosatrienoic | 20:3 ω-3 |
| Sciadonic | SCI | cis-5,11,14-eicosatrienoic | 20:3b ω-6 |
| Juniperonic | JUP | cis-5,11,14,17-eicosatetraenoic | 20:4b ω-3 |
| Eicosatetraenoic | ETA | cis-8,11,14,17-eicosatetraenoic | 20:4 ω-3 |
| Eicosapentaenoic | EPA | cis-5,8,11,14,17-eicosapentaenoic | 20:5 ω-3 |
| Docosatrienoic | DRA | cis-10,13,16-docosatrienoic | 22:3 ω-3 |
| Docosatetraenoic | DTA | cis-7,10,13,16-docosatetraenoic | 22:4 ω-3 |
| Docosapentaenoic | DPAn-6 | cis-4,7,10,13,16-docosapentaenoic | 22:5 ω-6 |
| Docosapentaenoic | DPA | cis-7,10,13,16,19-docosapentaenoic | 22:5 ω-3 |
| Docosahexaenoic | DHA | cis-4,7,10,13,16,19-docosahexaenoic | 22:6 ω-3 |

The term "high-level EPA production" refers to production of at least about 25% EPA in the total lipids of the microbial host, preferably at least about 30% EPA in the total lipids, more preferably at least about 35% EPA in the total lipids, more preferably at least about 40% EPA in the total lipids, more preferably at least about 40-45% EPA in the total lipids, more preferably at least about 45-50% EPA in the total lipids, more preferably at least about 50-60%, and most preferably at least about 60-70% EPA in the total lipids. The structural form of the EPA is not limiting; thus, for example, the EPA may exist in the total lipids as free fatty acids or in esterified forms such as acylglycerols, phospholipids, sulfolipids or glycolipids.

The term "lacks GLA" refers to less than about 1% detectable GLA in the total lipids of the microbial host, when measured by GC analysis using equipment having a detectable level down to about 0.1%.

The term "devoid of any DHA" refers to lack of any detectable DHA in the total lipids of the microbial host, when measured by GC analysis using equipment having a detectable level down to about 0.1%.

A metabolic pathway, or biosynthetic pathway, in a biochemical sense, can be regarded as a series of chemical reactions occurring in order within a cell, catalyzed by enzymes, to achieve either the formation of a metabolic product to be used or stored by the cell, or the initiation of another metabolic pathway (then called a flux generating step). Many of these pathways are elaborate, and involve a step by step modification of the initial substance to shape it into a product having the exact chemical structure desired.

The term "PUFA biosynthetic pathway" refers to a metabolic process that converts oleic acid to ω-6 fatty acids such as LA, EDA, GLA, DGLA, ARA, DRA, DTA and DPAn-6 and ω-3 fatty acids such as ALA, STA, ETrA, ETA, EPA, DPA and DHA. This process is well described in the literature (e.g., see PCT Publication No. WO 2006/052870). Briefly, this process involves elongation of the carbon chain through the addition of carbon atoms and desaturation of the molecule through the addition of double bonds, via a series of special elongation and desaturation enzymes termed "PUFA biosynthetic pathway enzymes" that are present in the endoplasmic reticulum membrane. More specifically, "PUFA biosynthetic pathway enzymes" refer to any of the following enzymes (and genes which encode said enzymes) associated with the biosynthesis of a PUFA, including: a $\Delta 4$ desaturase, a $\Delta 5$ desaturase, a $\Delta 6$ desaturase, a $\Delta 12$ desaturase, a $\Delta 15$ desaturase, a $\Delta 17$ desaturase, a $\Delta 9$ desaturase, a $\Delta 8$ desaturase, a $\Delta 9$ elongase, a $C_{14/16}$ elongase, a $C_{16/18}$ elongase, a $C_{18/20}$ elongase and/or a $C_{20/22}$ elongase.

The term "$\omega$-3/$\omega$-6 fatty acid biosynthetic pathway" refers to a set of genes which, when expressed under the appropriate conditions, encode enzymes that catalyze the production of either or both $\omega$-3 and $\omega$-6 fatty acids. Typically the genes involved in the $\omega$-3/$\omega$-6 fatty acid biosynthetic pathway encode PUFA biosynthetic pathway enzymes. A representative pathway is illustrated in FIG. 1A and FIG. 1B, providing for the conversion of myristic acid through various intermediates to DHA, which demonstrates how both $\omega$-3 and $\omega$-6 fatty acids may be produced from a common source. The pathway is naturally divided into two portions where one portion will generate $\omega$-3 fatty acids and the other portion, only $\omega$-6 fatty acids. That portion that only generates $\omega$-3 fatty acids will be referred to herein as the $\omega$-3 fatty acid biosynthetic pathway, whereas that portion that generates only $\omega$-6 fatty acids will be referred to herein as the $\omega$-6 fatty acid biosynthetic pathway.

The term "functional" as used herein relating to the $\omega$-3/$\omega$-6 fatty acid biosynthetic pathway, means that some (or all) of the genes in the pathway express active enzymes, resulting in in vivo catalysis or substrate conversion. It should be understood that "$\omega$-3/$\omega$-6 fatty acid biosynthetic pathway" or "functional $\omega$-3/$\omega$-6 fatty acid biosynthetic pathway" does not imply that all of the PUFA biosynthetic pathway genes in the above paragraph are required, as a number of fatty acid products will require only the expression of a subset of the genes of this pathway.

The term "$\Delta 9$ elongase/$\Delta 8$ desaturase pathway" will refer to a PUFA biosynthetic pathway that minimally includes at least one $\Delta 9$ elongase and at least one $\Delta 8$ desaturase, thereby enabling biosynthesis of DGLA and/or ETA from LA and ALA, respectively, with EDA and/or ETrA as intermediate fatty acids. With expression of other desaturases and elongases, ARA, DTA, DPAn-6, EPA, DPA and DHA may also be synthesized.

The term "$\Delta 6$ desaturase/$\Delta 6$ elongase pathway" will refer to a PUFA biosynthetic pathway that minimally includes at least one $\Delta 6$ desaturase and at least one $C_{18/20}$ elongase, thereby enabling biosynthesis of DGLA and/or ETA from LA and ALA, respectively, with GLA and/or STA as intermediate fatty acids. With expression of other desaturases and elongases, ARA, DTA, DPAn-6, EPA, DPA and DHA may also be synthesized.

The term "intermediate fatty acid" refers to any fatty acid produced in a fatty acid metabolic pathway that can be further converted to an intended product fatty acid in this pathway by the action of other metabolic pathway enzymes. For instance, when EPA is produced using the $\Delta 9$ elongase/$\Delta 8$ desaturase pathway, EDA, ETrA, DGLA, ETA and ARA can be produced and are considered "intermediate fatty acids" since these fatty acids can be further converted to EPA via action of other metabolic pathway enzymes.

The term "by-product fatty acid" refers to any fatty acid produced in a fatty acid metabolic pathway that is not the intended fatty acid product of the pathway nor an "intermediate fatty acid" of the pathway. For instance, when EPA is produced using the $\Delta 9$ elongase/$\Delta 8$ desaturase pathway, sciadonic acid and juniperonic acid also can be produced by the action of a $\Delta 5$ desaturase on either EDA or ETrA, respectively. They are considered to be "by-product fatty acids" since neither can be further converted to EPA by the action of other metabolic pathway enzymes.

The term "desaturase" refers to a polypeptide that can desaturate, i.e., introduce a double bond, in one or more fatty acids to produce a fatty acid or precursor of interest. Despite use of the omega-reference system throughout the specification to refer to specific fatty acids, it is more convenient to indicate the activity of a desaturase by counting from the carboxyl end of the substrate using the delta-system. Of particular interest herein are: 1) $\Delta 8$ desaturases that catalyze the conversion of EDA to DGLA and/or ETrA to ETA; 2) $\Delta 5$ desaturases that catalyze the conversion of DGLA to ARA and/or ETA to EPA; 3) $\Delta 17$ desaturases that desaturate a fatty acid between the $17^{th}$ and $18^{th}$ carbon atom numbered from the carboxyl-terminal end of the molecule and which, for example, catalyze the conversion of ARA to EPA and/or DGLA to ETA; and, 4) $\Delta 12$ desaturases that catalyze the conversion of oleic acid to LA.

Delta-17 ($\Delta 17$) desaturases, and also $\Delta 15$ desaturases, are also occasionally referred to as "omega-3 desaturases", "w-3 desaturases", and/or "$\omega$-3 desaturases", based on their ability to convert $\omega$-6 fatty acids into their $\omega$-3 counterparts (e.g., conversion of LA into ALA or DGLA into ETA and ARA into EPA, respectively).

Some desaturases have activity on two or more substrates. Based on this ability, these enzymes can be further classified with respect to their desaturase activities as being either "monofunctional" or "bifunctional". It may be desirable to empirically determine the specificity of a fatty acid desaturase by transforming a suitable host with the gene for the fatty acid desaturase and determining its effect on the fatty acid profile of the host. By "enzymatic substrate" it is meant that the desaturase polypeptide binds the substrate at an active site and acts upon it in a reactive manner.

The term "EgD8" refers to a $\Delta 8$ desaturase (SEQ ID NOs: 18 and 19) isolated from *Euglena gracilis*; EgD8 is 100% identical and functionally equivalent to the protein designated as "Eg5", described in U.S. Pat. No. 7,256,033. The term "EgD8S" refers to a synthetic $\Delta 8$ desaturase (SEQ ID NOs:20 and 21) derived from the *Euglena gracilis* $\Delta 8$ desaturase identified as "EgD8", wherein EgD8S was codon-optimized for expression in *Yarrowia lipolytica*. EgD8S is 100% identical and functionally equivalent to "D8SF", described in U.S. Pat. No. 7,256,033.

The term "EgD8M" refers to a mutant $\Delta 8$ desaturase (SEQ ID NOs:22 and 23) that has at least one mutation with respect to the synthetic $\Delta 8$ desaturase derived from *Euglena gracilis* that is codon-optimized for expression in *Yarrowia lipolytica* (i.e., EgD8S). More specifically, although "mutations" may include any deletions, insertions and point mutations (or combinations thereof), in preferred embodiments the mutant EgD8M is described as mutant EgD8S-23 (SEQ ID NO:23). Specifically, mutant EgD8S-23 (described in Patent Publication US 2008-0138868 A1) comprises the following 24 amino acid mutations with respect to the synthetic codon-optimized EgD8S sequence set forth as SEQ ID NO:21: 4S to A, 5K to S, 12T to V, 16T to K, 17T to V, 66P to Q, 67S to A, 108S to L, 117G to A, 118Y to F, 120L to M, 121M to L, 125Q to H, 126M to L, 132V to L, 133 L to V, 162L to V, 163V to L, 293L to M, 407A to S, 408V to Q, 418A to G, 419G to A and 422L to Q. Pairwise alignment of the mutant EgD8S-23 amino acid sequence (SEQ ID NO:23) to the synthetic codon-optimized sequence of SEQ ID NO:21 using default parameters of Vector NTI®'s AlignX program (Invitrogen Corporation, Carlsbad, Calif.) revealed 94.3% sequence identity and 97.9% consensus between the two proteins over a length of 422 amino acids. The Δ8 desaturase activity of the mutant EgD8S-23 (SEQ ID NO:23) is at least about functionally equivalent to the □8 desaturase activity of the synthetic codon-optimized EgD8S (SEQ ID NO:21).

The term "EaD8" refers to a Δ8 desaturase enzyme (SEQ ID NO:25) isolated from *Euglena anabaena* UTEX 373, encoded by SEQ ID NO:24 herein. Similarly, the term "EaD8S" refers to a synthetic Δ8 desaturase derived from *Euglena anabaena* UTEX 373 that is codon-optimized for expression in *Yarrowia lipolytica* (i.e., SEQ ID NOs:26 and 27). EaD8 and EaD8S are described in U.S. patent application Ser. No. 12/099,811 (filed Apr. 9, 2008); EaD8 was designated therein as "EaD8Des3".

The term "EgD5" refers to a Δ5 desaturase enzyme (SEQ ID NO:35) isolated from *Euglena gracilis*, encoded by SEQ ID NO:34 herein. Similarly, the term "EgD5S" refers to a synthetic Δ5 desaturase derived from *Euglena gracilis* that is codon-optimized for expression in *Yarrowia lipolytica* (i.e., SEQ ID NOs:36 and 37). EgD5 and EgD5S are described in PCT Publication No. WO 2007/136671.

For the purposes herein, the term "RD5" refers to a Δ5 desaturase enzyme (SEQ ID NO:39) isolated from *Peridinium* sp. CCMP626, encoded by SEQ ID NO:38 herein. Similarly, the term "RD5S" refers to a synthetic Δ5 desaturase derived from *Peridinium* sp. CCMP626 that is codon-optimized for expression in *Yarrowia lipolytica* (i.e., SEQ ID NOs:40 and 41). RD5 and RD5S are described in U.S. patent application Ser. No. 11/748,637 (filed May 15, 2007).

The term "EaD5" refers to a Δ5 desaturase enzyme (SEQ ID NO:43) isolated from *Euglena anabaena* UTEX 373, encoded by SEQ ID NO:42 herein. Similarly, the term "EaD5S" refers to a synthetic Δ5 desaturase derived from *Euglena anabaena* UTEX 373 that is codon-optimized for expression in *Yarrowia lipolytica* (i.e., SEQ ID NOs:44 and 45). EaD5 and EaD5S are described in U.S. patent application Ser. No. 12/111,237 (filed Apr. 29, 2008); EaD5 was designated therein as "EaD5Des1".

The term "mutant Δ5 desaturase" refers to a Δ5 desaturase as described herein that has at least one mutation within the His-Pro-Gly-Gly (HPGG; SEQ ID NO:182) motif of the cytochrome $b_5$ domain, wherein said mutation results in an amino acid substitution (either conservative or non-conservative). Although the mutations may include any amino acid substitution, the mutant Δ5 desaturase preferably comprises at least a mutant motif selected from the group consisting of His-Xaa-Gly-Gly (SEQ ID NO:182) and His-Pro-Gly-Xaa (SEQ ID NO:184) and the Δ5 desaturase activity of the mutant Δ5 desaturase is at least about functionally equivalent to the Δ5 desaturase activity of the wildtype Δ5 desaturase. More preferred, the mutant motif is selected from the group consisting of: His-Gly-Gly-Gly (HGGG; SEQ ID NO:185), His-His-Gly-Gly (HHGG; SEQ ID NO:186), His-Cys-Gly-Gly (HCGG; SEQ ID NO:188), His-Trp-Gly-Gly (HWGG; SEQ ID NO:189) and His-Pro-Gly-Ser (HPGS; SEQ ID NO:187); see for example, the Δ5 desaturases set forth as SEQ ID NO:122, SEQ ID NO:124, SEQ ID NO:125, SEQ ID NO:126, SEQ ID NO:196, SEQ ID NO:197, SEQ ID NO:198, SEQ ID NO:199, SEQ ID NO:200 and SEQ ID NO:201.

Each "mutant Δ5 desaturase" has a "corresponding wildtype Δ5 desaturase". Specifically, the mutant Δ5 desaturase and corresponding wildtype Δ5 desaturase share identical amino acid sequences, with the exception that the wildtype will comprise a HPGG (SEQ ID NO:182) motif within the cytochrome $b_5$ domain, while the mutant will comprise at least one mutation within this motif (as described above).

A mutant Δ5 desaturase is "at least about functionally equivalent" to the corresponding wildtype Δ5 desaturase when enzymatic activity and specific selectivity of the mutant Δ5 sequence are comparable to that of the corresponding wildtype Δ5 desaturase (or activity is increased). Thus, a functionally equivalent mutant Δ5 desaturase will possess Δ5 desaturase activity that is not substantially reduced with respect to that of the corresponding wildtype Δ5 desaturase when the "conversion efficiency" of each enzyme is compared (i.e., a mutant Δ5 desaturase will have at least about 50%, preferably at least about 75%, more preferably at least about 85%, and most preferably at least about 95% of the enzymatic activity of the wildtype Δ5 desaturase). The Δ5 desaturase activity of the two polypeptides may be substantially identical. Preferably, the mutant Δ5 desaturase will have increased enzymatic activity and specific selectivity when compared to that of the corresponding wildtype Δ5 desaturase, i.e., having at least about 101-105%, more preferably at least about 106-115% and most preferably at least about 116-125% of the enzymatic activity of the wildtype Δ5 desaturase.

The term "PaD17" refers to a Δ17 desaturase enzyme (SEQ ID NO:51) isolated from *Pythium aphanidermatum*, encoded by SEQ ID NO:50. Similarly, the term "PaD17S" refers to a synthetic Δ17 desaturase derived from *Pythium aphanidermatum* that is codon-optimized for expression in *Yarrowia lipolytica* (i.e., SEQ ID NOs:52 and 53). Based on analyses described in U.S. patent application Ser. No. 11/779,915 (filed Jul. 19, 2007), PaD17 and PaD17S are further classified as bifunctional Δ17 desaturases. Specifically, "bifunctional Δ17 desaturase", "bifunctional Δ17 desaturase activity" or "primary Δ17 desaturase activity" refers to a Δ17 desaturase that preferentially converts ARA to EPA and/or DGLA to ETA but additionally has limited ability to convert LA into ALA (thus exhibiting primarily Δ17 desaturase activity and limited Δ15 desaturase activity). In contrast, "monofunctional Δ17 desaturase", "monofunctional Δ17 desaturase activity" or "exclusive Δ17 desaturase activity" refers to a Δ17 desaturase that is capable of converting ARA to EPA and/or DGLA to ETA but not LA to ALA.

The term "PrD17" refers to a Δ17 desaturase enzyme (SEQ ID NO:47) identified from *Phytophthora ramorum*, encoded by SEQ ID NO:46. In contrast, the term "PrD17S" refers to a synthetic Δ17 desaturase derived from *Phytophthora ramorum* that is codon-optimized for expression in *Yarrowia lipolytica* (i.e., SEQ ID NOs:48 and 49). PrD17 and PrD17S are identified as bifunctional Δ17 desaturases; they are described in U.S. patent application Ser. No. 11/787,772 (filed Apr. 18, 2007) and in U.S. patent application Ser. No. 11/779,915 (filed Jul. 19, 2007).

The term "*Fusarium moniliforme*" is synonymous with "*Fusarium verticillioides*" and is also synonymous with "*Gibberella fujikuroi*". The term "FmD12" refers to a Δ12 desaturase enzyme (SEQ ID NO:55) isolated from *Fusarium moniliforme*, encoded by SEQ ID NO:54. FmD12 is identical to the *Gibberella fujikuroi* Δ12 desaturase described as GenBank Accession No. DQ272515. Similarly, the term "FmD12S" refers to a synthetic Δ12 desaturase derived from *Fusarium moniliforme* that is codon-optimized for expression in *Yarrowia lipolytica* (i.e., SEQ ID NOs:56 and 57). FmD12 is described in PCT Publication No. WO 2005/047485.

Other desaturases of particular interest herein include: 1) Δ15 desaturases that catalyze the conversion of LA to ALA and/or GLA to STA; and, 2) Δ9 desaturases that catalyze the conversion of palmitate to palmitoleic acid (16:1) and/or stearic acid to oleic acid (18:1).

The term "FmD15" refers to a Δ15 desaturase enzyme (SEQ ID NO:63) isolated from *Fusarium moniliforme*, encoded by SEQ ID NO:62. FmD15 is identical to the *Gibberella fujikurOi* Δ15 desaturase described as GenBank Accession No. DQ272516. Similarly, the term "FmD15S" refers to a synthetic Δ15 desaturase derived from *Fusarium moniliforme* that is codon-optimized for expression in *Yarrowia lipolytica* (i.e., SEQ ID NOs:64 and 65). Based on analyses described in PCT Publication No. WO 2005/047480, FmD15 is further classified as a bifunctional Δ15 desaturase; FmD15S is expected to function similarly. Specifically, "bifunctional Δ15 desaturase", "bifunctional Δ15 desaturase activity" or "primary Δ15 desaturase activity" refers to a Δ15 desaturase that preferentially converts LA to ALA but additionally has limited ability to convert oleic acid to LA (thus exhibiting primarily Δ15 desaturase activity and limited Δ12 desaturase activity). In contrast, "monofunctional Δ15 desaturase", "monofunctional Δ15 desaturase activity" or "exclusive Δ15 desaturase activity" refers to a Δ15 desaturase that is capable of converting LA to ALA but not oleic acid to LA.

The term "YID9" refers to a Δ9 desaturase enzyme (SEQ ID NO:67) isolated from *Yarrowia lipolytica*, encoded by SEQ ID NO:66 (see also GenBank Accession No. XM_501496).

Other useful PUFA desaturases include: 1) Δ6 desaturases that catalyze the conversion of LA to GLA and/or ALA to STA; and, 2) Δ4 desaturases that catalyze the conversion of DPA to DHA and/or DTA to DPAn-6.

The term "elongase" refers to a polypeptide that can elongate a fatty acid carbon chain to produce an acid 2 carbons longer than the fatty acid substrate that the elongase acts upon. This process of elongation occurs in a multi-step mechanism in association with fatty acid synthase, as described in PCT Publication No. WO 2005/047480. Examples of reactions catalyzed by elongase systems are the conversion of GLA to DGLA, STA to ETA, ARA to DTA and EPA to DPA. In general, the substrate selectivity of elongases is somewhat broad but segregated by both chain length and the degree and type of unsaturation. For example, a $C_{14/16}$ elongase will utilize a $C_{14}$ substrate (e.g., myristic acid), a $C_{16/18}$ elongase will utilize a $C_{16}$ substrate (e.g., palmitate), a $C_{18/20}$ elongase (also known as a Δ6 elongase as the terms can be used interchangeably) will utilize a $C_{18}$ substrate (e.g., GLA, STA) and a $C_{20/22}$ elongase will utilize a $C_{20}$ substrate (e.g., ARA, EPA). In like manner, a Δ9 elongase is able to catalyze the conversion of LA and ALA to EDA and ETrA, respectively.

It is important to note that some elongases have broad specificity and thus a single enzyme may be capable of catalyzing several elongase reactions (e.g., thereby acting as both a $C_{16/18}$ elongase and a $C_{18/20}$ elongase). It may be desirable to empirically determine the specificity of a fatty acid elongase by transforming a suitable host with the gene for the fatty acid elongase and determining its effect on the fatty acid profile of the host.

The term "EgD9e" refers to a Δ9 elongase enzyme (SEQ ID NO:5) isolated from *Euglena gracilis*, encoded by SEQ ID NO:4. In contrast, the term "EgD9eS" refers to a synthetic Δ9 elongase derived from *Euglena gracilis* that is codon-optimized for expression in *Yarrowia lipolytica* (i.e., SEQ ID NOs:6 and 7). EgD9e and EgD9eS are described in PCT Publication No. WO 2007/061742.

The term "E389D9e" refers to a Δ9 elongase enzyme (SEQ ID NO:9) isolated from *Eutreptiella* sp. CCMP389, encoded by SEQ ID NO:8. In contrast, the term "E389D9eS" refers to a synthetic Δ9 elongase derived from *Eutreptiella* sp. CCMP389 that is codon-optimized for expression in *Yarrowia lipolytica* (i.e., SEQ ID NOs:10 and 11). E389D9e and E389D9eS are described in PCT Publication No. WO 2007/061742.

The term "EaD9e" refers to a Δ9 elongase enzyme (SEQ ID NO:13) isolated from *Euglena anabaena* UTEX 373, encoded by SEQ ID NO:12. Likewise, the term "EaD9eS" refers to a synthetic Δ9 elongase derived from *Euglena anabaena* UTEX 373 that is codon-optimized for expression in *Yarrowia lipolytica* (i.e., SEQ ID NOs:14 and 15). EaD9e and EaD9eS are described in U.S. patent application Ser. No. 12/102,879 (filed Apr. 15, 2008); EaD9e was designated therein as "EaD9EIo1".

The term "ELO3" refers to a *Mortierella alpina* $C_{16/18}$ fatty acid elongase enzyme (SEQ ID NO:59), encoded by the elo3 gene (SEQ ID NO:58) that preferentially catalyzes the conversion of palmitate (16:0) to stearic acid (18:0). ELO3 is described in PCT Publication No. WO 2007/046817. Relatedly, the term "ME3S" refers to a synthetic $C_{16/18}$ fatty acid elongase derived from *Mortierella alpina* that is codon-optimized for expression in *Yarrowia lipolytica* (i.e., SEQ ID NOs:60 and 61).

The terms "conversion efficiency" and "percent substrate conversion" refer to the efficiency by which a particular enzyme, such as a desaturase or elongase, can convert substrate to product. The conversion efficiency is measured according to the following formula: ([product]/[substrate+product])*100, where 'product' includes the immediate product and all products in the pathway derived from it.

The term "acyltransferase" refers to an enzyme responsible for transferring a group other than an amino-acyl group (EC 2.3.1.-).

The term "DAG AT" refers to a diacylglycerol acyltransferase (also known as an acyl-CoA-diacylglycerol acyltransferase or a diacylglycerol O-acyltransferase) (EC 2.3.1.20). This enzyme is responsible for the conversion of acyl-CoA and 1,2-diacylglycerol to TAG and CoA, thereby involved in the terminal step of TAG biosynthesis. Two families of DAG AT enzymes exist: DGAT1 and DGAT2. The former family shares homology with the acyl-CoA:cholesterol acyltransferase ["ACAT"] gene family, while the latter family is unrelated (Lardizabal et al., *J. Biol. Chem.*, 276(42):38862-38869 (2001)).

The term "YlDGAT2" refers to a DGAT2 enzyme (SEQ ID NO:94) isolated from *Yarrowia lipolytica*, encoded by SEQ ID NO:93. YlDGAT2 is described in U.S. Pat. No. 7,267,976. It has been determined that the YlDGAT2 protein is 514 amino acid residues in length (corresponding to nucleotides +291 to +1835 of SEQ ID NO:93), and thus two additional nested ORFs within SEQ ID NO:93 encode only truncated forms of the complete protein.

The term "diacylglycerol cholinephosphotransferase" refers to an enzyme (EC 2.7.8.2) that catalyses the synthesis of phosphatidylcholines from CDP-choline and 1,2-diacylglycerols. This enzyme is part of the CDP-choline pathway, responsible for phosphatidylcholine ["PC"] biosynthesis.

The term "YlCPT1" refers to a diacylglycerol cholinephospho-transferase enzyme (SEQ ID NO:69) isolated from *Yarrowia lipolytica*, encoded by SEQ ID NO:68. YlCPT1 is described in PCT Publication No. WO 2006/052870 (see also GenBank Accession No. XM_501703 (YALI0C10989g)).

The term "peroxisomes" refers to ubiquitous organelles found in all eukaryotic cells. They have a single lipid bilayer membrane that separates their contents from the cytosol and that contains various membrane proteins essential to the functions described below. Peroxisomes selectively import proteins via an "extended shuttle mechanism". More specifically, there are at least 32 known peroxisomal proteins, called peroxins, which participate in the process of importing proteins by means of ATP hydrolysis through the peroxisomal membrane. Some peroxins comprise a specific protein signal, i.e., a peroxisomal targeting signal or "PTS", at either the N-terminus or C-terminus to signal that importation through the peroxisomal membrane should occur. Once cellular proteins are imported into the peroxisome, they are typically subjected to some means of degradation. For example, peroxisomes contain oxidative enzymes, such as e.g., catalase, D-amino acid oxidase and uric acid oxidase, that enable degradation of substances that are toxic to the cell. Alternatively, peroxisomes breakdown fatty acid molecules to produce free molecules of acetyl-CoA which are exported back to the cytosol, in a process called β-oxidation.

The terms "peroxisome biogenesis factor protein", "peroxin" and "Pex protein" are interchangeable and refer to proteins involved in peroxisome biogenesis and/or that participate in the process of importing cellular proteins by means of ATP hydrolysis through the peroxisomal membrane. The acronym of a gene that encodes any of these proteins is "Pex gene". A system for nomenclature is described by Distel et al., *J. Cell Biol.*, 135:1-3 (1996). At least 32 different Pex genes have been identified so far in various eukaryotic organisms. Many Pex genes have been isolated from the analysis of mutants that demonstrated abnormal peroxisomal functions or structures. Based on a review by Kiel, J. A. K. W., et al. (*Traffic*, 7:1291-1303 (2006)), wherein in silico analysis of the genomic sequences of 17 different fungal species was performed, the following Pex proteins were identified: Pex1p, Pex2p, Pex3p, Pex3 Bp, Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21Bp, Pex22p, Pex22p-like and Pex26p. Collectively, these proteins will be referred to herein as "Pex proteins", encoded by "Pex genes".

The term "conserved domain" or "motif" means a set of amino acids conserved at specific positions along an aligned sequence of evolutionarily related proteins. While amino acids at other positions can vary between homologous proteins, amino acids that are highly conserved at specific positions indicate amino acids that are essential in the structure, the stability, or the activity of a protein. Because they are identified by their high degree of conservation in aligned sequences of a family of protein homologues, they can be used as identifiers, or "signatures", to determine if a protein with a newly determined sequence belongs to a previously identified protein family. Of relevance herein, motifs found in Δ5 desaturase enzymes (i.e., animal, plants and fungi) include three histidine boxes (i.e., H(X)$_{3-4}$H [SEQ ID NOs:190 and 191], H(X)$_{2-3}$HH [SEQ ID NOs:192 and 193] and H/Q(X)$_{2-3}$HH [SEQ ID NOs:194 and 195]) and a heme-binding motif (i.e., His-Pro-Gly-Gly or HPGG; SEQ ID NO:182) within the fused cytochrome b$_5$ domain at the N-terminus. Similarly, Pex2p, Pex10p and Pex12p all share a cysteine-rich motif near their carboxyl termini, known as a C$_3$HC$_4$ zinc ring finger motif. This motif appears to be required for their activities, involved in protein docking and translocation into the peroxisome (Kiel, J. A. K. W., et al., *Traffic*, 7:1291-1303 (2006)).

The term "C$_3$HC$_4$ zinc ring finger motif" or "C$_3$HC$_4$ motif" generically refers to a conserved cysteine-rich motif that binds two zinc ions, identified by the presence of a sequence of amino acids as set forth in Formula I:

$$CX_2CX_{9-27}CX_{1-3}HX_2CX_2CX_{4-48}CX_2C \qquad \text{Formula I}$$

The C$_3$HC$_4$ zinc ring finger motif within the *Yarrowia lipolytica* gene encoding the peroxisome biogenesis factor 10 protein (i.e., YlPex10p) is located between amino acids 327-364 of SEQ ID NO:104 and is defined by a CX$_2$CX$_{11}$CX$_1$HX$_2$CX$_2$CX$_{10}$CX$_2$C motif (SEQ ID NO:119). The C$_3$HC$_4$ zinc ring finger motif within the *Yarrowia lipolytica* gene encoding the peroxisome biogenesis factor 2 protein (i.e., YlPex2p) is located between amino acids 266-323 of SEQ ID NO:96. The *Yarrowia lipolytica* peroxisome biogenesis factor 12 protein (i.e., YlPex12p) contains an imperfect C$_3$HC$_4$ ring-finger motif located between amino acids 342-391 of SEQ ID NO:105. The protein sequences corresponding to the C$_3$HC$_4$ zinc ring finger motif of YlPex10, YlPex2 and YlPex12 are aligned in FIG. 2A; astericks correspond to the conserved cysteine or histidine residues of the motif.

YlPex10, YlPex2 and YlPex12 are thought to form a ring finger complex by protein-protein interaction. The proposed interaction between the cystine and histidine residues of the YlPex10p C$_3$HC$_4$ finger motif with two zinc residues is schematically diagrammed in FIG. 2B.

The term "Pex10" refers to the gene encoding the peroxisome biogenesis factor 10 protein or peroxisomal assembly protein Peroxin 10, wherein the peroxin protein will hereinafter be referred to as "Pex10p". The function of Pex10p has not been clearly elucidated, although studies in other organisms have revealed that Pex10 products are localized in the peroxisomal membrane and are essential to the normal functioning of the organelle. A C$_3$HC$_4$ zinc ring finger motif appears to be conserved in the C-terminal region of Pex10p (Kalish, J. E. et al., *Mol. Cell. Biol.*, 15:6406-6419 (1995); Tan, X. et al., *J. Cell Biol.*, 128:307-319 (1995); Warren, D. S., et al., *Am. J. Hum. Genet.*, 63:347-359 (1998)) and is required for enzymatic activity.

The term "YlPex10" refers to the *Yarrowia lipolytica* gene encoding the peroxisome biogenesis factor 10 protein, wherein the protein will hereinafter be referred to as "YlPex10p". This particular peroxin was recently studied by Sumita et al. (*FEMS Microbiol. Lett.*, 214:31-38 (2002)). The nucleotide sequence of YlPex10 was registered in GenBank under multiple accession numbers, including GenBank Accession No. CAG81606 (SEQ ID NO:104), No. AB036770 (SEQ ID NOs:114, 115 and 116) and No. AJ012084 (SEQ ID NOs:117 and 118). The YlPex10p sequence set forth in SEQ ID NO:118 is 354 amino acids in length. In contrast, the YlPex10p sequences set forth in SEQ ID NO:104 and SEQ ID NO:116 are each 377 amino acids in length, as the 100% identical sequences possess an additional 23 amino acids at the N-terminus of the protein (corresponding to a different start codon than that identified in GenBank Accession No. AJ012084 (SEQ ID NO:118)).

The term "disruption" in or in connection with a native Pex gene refers to an insertion, deletion, or targeted mutation within a portion of that gene, that results in either a complete gene knockout such that the gene is deleted from the genome and no protein is translated or a translated Pex protein having an insertion, deletion, amino acid substitution or other targeted mutation. The location of the disruption in the protein may be, for example, within the N-terminal portion of the protein or within the C-terminal portion of the protein. The disrupted Pex protein will have impaired activity with respect to the Pex protein that was not disrupted, and can be nonfunctional. A disruption in a native gene encoding a Pex protein also includes alternate means that result in low or lack of expression of the Pex protein, such as could result via manipulating the regulatory sequences, transcription and translation factors and/or signal transduction pathways or by use of sense, antisense or RNAi technology, etc.

The term "oleaginous" refers to those organisms that tend to store their energy source in the form of oil (Weete, In: Fungal Lipid Biochemistry, $2^{nd}$ Ed., Plenum, 1980). The term "oleaginous yeast" refers to those microorganisms classified as yeasts that can make oil, that is, TAGs. Generally, the cellular oil or TAG content of oleaginous microorganisms follows a sigmoid curve, wherein the concentration of lipid increases until it reaches a maximum at the late logarithmic or early stationary growth phase and then gradually decreases during the late stationary and death phases (Yongmanitchai and Ward, *Appl. Environ. Microbiol.*, 57:419-25 (1991)). It is not uncommon for oleaginous microorganisms to accumulate in excess of about 25% of their dry cell weight as oil. Examples of oleaginous yeast include, but are no means limited to, the following genera: *Yarrowia, Candida, Rhodotorula, Rhodosporidium, Cryptococcus, Trichosporon* and *Lipomyces*.

The term "fermentable carbon source" means a carbon source that a microorganism will metabolize to derive energy. Typical carbon sources include, but are not limited to: monosaccharides, oligosaccharides, polysaccharides, alkanes, fatty acids, esters of fatty acids, monoglycerides, diglycerides, triglycerides, carbon dioxide, methanol, formaldehyde, formate and carbon-containing amines.

As used herein, the terms "isolated nucleic acid fragment", "isolated nucleic acid molecule" and "genetic construct" will be used interchangeably and will refer to a polymer of RNA or DNA that is single- or double-stranded, optionally containing synthetic, non-natural or altered nucleotide bases. An isolated nucleic acid fragment in the form of a polymer of DNA may be comprised of one or more segments of cDNA, genomic DNA or synthetic DNA.

A "substantial portion" of an amino acid or nucleotide sequence is that portion comprising enough of the amino acid sequence of a polypeptide or the nucleotide sequence of a gene to putatively identify that polypeptide or gene, either by manual evaluation of the sequence by one skilled in the art, or by computer-automated sequence comparison and identification using algorithms such as BLAST (Basic Local Alignment Search Tool; Altschul, S. F., et al., *J. Mol. Biol.*, 215: 403-410 (1993)). In general, a sequence of ten or more contiguous amino acids or thirty or more nucleotides is necessary in order to identify putatively a polypeptide or nucleic acid sequence as homologous to a known protein or gene. Moreover, with respect to nucleotide sequences, gene-specific oligonucleotide probes comprising 20-30 contiguous nucleotides may be used in sequence-dependent methods of gene identification (e.g., Southern hybridization) and isolation, such as in situ hybridization of bacterial colonies or bacteriophage plaques. In addition, short oligonucleotides of 12-15 bases may be used as amplification primers in PCR in order to obtain a particular nucleic acid fragment comprising the primers. Accordingly, a "substantial portion" of a nucleotide sequence comprises enough of the sequence to specifically identify and/or isolate a nucleic acid fragment comprising the sequence.

The term "complementary" is used to describe the relationship between nucleotide bases that are capable of hybridizing to one another. For example, with respect to DNA, adenosine is complementary to thymine and cytosine is complementary to guanine.

"Codon degeneracy" refers to the nature in the genetic code permitting variation of the nucleotide sequence without effecting the amino acid sequence of an encoded polypeptide. The skilled artisan is well aware of the "codon-bias" exhibited by a specific host cell in usage of nucleotide codons to specify a given amino acid. Therefore, when synthesizing a gene for improved expression in a host cell, it is desirable to design the gene such that its frequency of codon usage approaches the frequency of preferred codon usage of the host cell.

"Synthetic genes" can be assembled from oligonucleotide building blocks that are chemically synthesized using procedures known to those skilled in the art. These oligonucleotide building blocks are annealed and then ligated to form gene segments that are then enzymatically assembled to construct the entire gene. Accordingly, the genes can be tailored for optimal gene expression based on optimization of nucleotide sequence to reflect the codon bias of the host cell. The skilled artisan appreciates the likelihood of successful gene expression if codon usage is biased towards those codons favored by the host. Determination of preferred codons can be based on a survey of genes derived from the host cell, where sequence information is available. For example, the codon usage profile for *Yarrowia lipolytica* is provided in U.S. Pat. No. 7,125,672.

"Gene" refers to a nucleic acid fragment that expresses a specific protein, and which may refer to the coding region alone or may include regulatory sequences preceding (5' non-coding sequences) and following (3' non-coding sequences) the coding sequence. "Native gene" refers to a gene as found in nature with its own regulatory sequences. "Chimeric gene" refers to any gene that is not a native gene, comprising regulatory and coding sequences that are not found together in nature. Accordingly, a chimeric gene may comprise regulatory sequences and coding sequences that are derived from different sources, or regulatory sequences and coding sequences derived from the same source, but arranged in a manner different than that found in nature. "Endogenous gene" refers to a native gene in its natural location in the genome of an organism. A "foreign" gene refers to a gene that is introduced into the host organism by gene transfer. Foreign genes can comprise native genes inserted into a non-native organism, native genes introduced into a new location within the native host, or chimeric genes. A "transgene" is a gene that has been introduced into the genome by a transformation procedure. A "codon-optimized gene" is a gene having its frequency of codon usage designed to mimic the frequency of preferred codon usage of the host cell.

"Coding sequence" refers to a DNA sequence that codes for a specific amino acid sequence. "Suitable regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. Regulatory sequences may include promoters, enhancers, silencers, 5' untranslated leader sequence (e.g., between the transcription start site and the translation initiation codon), introns, polyadenylation recognition sequences, RNA processing sites, effector binding sites and stem-loop structures.

"Promoter" refers to a DNA sequence capable of controlling the expression of a coding sequence or functional RNA. In general, a coding sequence is located 3' to a promoter sequence. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental or physiological conditions. Promoters that cause a gene to be expressed in most cell types at most times are commonly referred to as "constitutive promoters". It is further recognized that since in most cases the exact boundaries of regulatory sequences have not been completely defined, DNA fragments of different lengths may have identical promoter activity.

The term "GPD promoter" or "GPD promoter region" refers to the 5' upstream untranslated region in front of the 'ATG' translation initiation codon of a glyceraldehyde-3-phosphate dehydrogenase enzyme (E.C. 1.2.1.12) encoded by the gpd gene and that is necessary for expression. Examples of suitable Yarrowia lipolytica GPD promoter regions are described in U.S. Pat. No. 7,259,255.

The term "GPDIN promoter" or "GPDIN promoter region" refers to the 5' upstream untranslated region in front of the 'ATG' translation initiation codon of the gpd gene and that is necessary for expression, plus a portion of 5' coding region that has an intron of the gpd gene. Examples of suitable Yarrowia lipolytica GPDIN promoter regions are described in Patent Publication US 2006/0019297-A1.

The term "GPM promoter" or "GPM promoter region" refers to the 5' upstream untranslated region in front of the 'ATG' translation initiation codon of a phosphoglycerate mutase enzyme (EC 5.4.2.1) encoded by the gpm gene and that is necessary for expression. Examples of suitable Yarrowia lipolytica GPM promoter regions are described in U.S. Pat. No. 7,259,255.

The term "GPM/FBAIN promoter" or "GPM/FBAIN promoter region" refers to a chimeric promoter comprising a fusion of the "GPM promoter" and the intron contained within the FBAIN promoter (infra). Examples of suitable Yarrowia lipolytica GPM/FBAIN promoter regions are described in U.S. Pat. No. 7,202,356.

The term "FBA promoter" or "FBA promoter region" refers to the 5' upstream untranslated region in front of the 'ATG' translation initiation codon of a fructose-bisphosphate aldolase enzyme (E.C. 4.1.2.13) encoded by the fba1 gene and that is necessary for expression. Examples of suitable Yarrowia lipolytica FBA promoter regions are described in U.S. Pat. No. 7,202,356.

The term "FBAIN promoter" or "FBAIN promoter region" refers to the 5' upstream untranslated region in front of the 'ATG' translation initiation codon of the fba1 gene and that is necessary for expression, plus a portion of 5' coding region that has an intron of the fba1 gene. Examples of suitable Yarrowia lipolytica FBAIN promoter regions are described in U.S. Pat. No. 7,202,356.

The term "FBAINm promoter" or "FBAINm promoter region" refers to a modified version of the FBAIN promoter, wherein FBAINm has a 52 bp deletion between the ATG translation initiation codon and the intron of the FBAIN promoter (thereby including only 22 amino acids of the N-terminus) and a new translation consensus motif after the intron. Furthermore, while the FBAIN promoter generates a fusion protein when fused with the coding region of a gene to be expressed, the FBAINm promoter does not generate such a fusion protein. Examples of suitable Yarrowia lipolytica FBAINm promoter regions are described in U.S. Pat. No. 7,202,356.

The term "GPAT promoter" or "GPAT promoter region" refers to the 5' upstream untranslated region in front of the 'ATG' translation initiation codon of a glycerol-3-phosphate O-acyltransferase enzyme (E.C. 2.3.1.15) encoded by the gpat gene and that is necessary for expression. Examples of suitable Yarrowia lipolytica GPAT promoter regions are described in U.S. Pat. No. 7,264,949.

The term "YAT1 promoter" or "YAT1 promoter region" refers to the 5' upstream untranslated region in front of the 'ATG' translation initiation codon of an ammonium transporter enzyme (TC 2.A.49; GenBank Accession No. XM_504457) encoded by the yat1 gene and that is necessary for expression. Examples of suitable Yarrowia lipolytica YAT1 promoter regions are described in Patent Publication US 2006/0094102-A1.

The term "EXP1 promoter" or "EXP1 promoter region" refers to the 5' upstream untranslated region in front of the 'ATG' translation initiation codon of a protein encoded by the Yarrowia lipolytica "YALI0C12034g" gene (GenBank Accession No. XM_501745) and that is necessary for expression. Based on significant homology of "YALI0C12034g" to the sp|Q12207 S. cerevisiae non-classical export protein 2 (whose function is involved in a novel pathway of export of proteins that lack a cleavable signal sequence), this gene is herein designated as the exp1 gene, encoding a protein designated as EXP1. An example of a suitable Yarrowia lipolytica EXP1 promoter region is described in PCT Publication No. WO 2006/052870.

"Introns" are sequences of non-coding DNA found in gene sequences (either in the coding region, 5' non-coding region, or 3' non-coding region) in most eukaryotes. Their full function is not known; however, some enhancers are located in introns (Giacopelli F. et al., Gene Expr., 11:95-104 (2003)). These intron sequences are transcribed, but removed from within the pre-mRNA transcript before the mRNA is translated into a protein. This process of intron removal occurs by self-splicing of the sequences, i.e., exons, on either side of the intron.

The term "enhancer" refers to a cis-regulatory sequence that can elevate levels of transcription from an adjacent eukaryotic promoter, thereby increasing transcription of the gene. Enhancers can act on promoters over many tens of kilobases of DNA and can be 5' or 3' to the promoter they regulate. Enhancers can also be located within introns.

The terms "3' non-coding sequence" and "transcription terminator" refer to DNA sequences located downstream of a coding sequence. This includes polyadenylation recognition sequences and other sequences encoding regulatory signals capable of affecting mRNA processing or gene expression. The polyadenylation signal is usually characterized by affecting the addition of polyadenylic acid tracts to the 3' end of the mRNA precursor. The 3' region can influence the transcription, RNA processing or stability, or translation of the associated coding sequence.

"RNA transcript" refers to the product resulting from RNA polymerase-catalyzed transcription of a DNA sequence. When the RNA transcript is a perfect complementary copy of the DNA sequence, it is referred to as the primary transcript or it may be a RNA sequence derived from post-transcriptional processing of the primary transcript and is referred to as the mature RNA. "Messenger RNA" or "mRNA" refers to the RNA that is without introns and which can be translated into protein by the cell. "cDNA" refers to a double-stranded DNA that is complementary to, and derived from, mRNA. "Sense" RNA refers to RNA transcript that includes the mRNA and so can be translated into protein by the cell. "Antisense RNA" refers to a RNA transcript that is complementary to all or part of a target primary transcript or mRNA and that blocks the expression of a target gene (U.S. Pat. No. 5,107,065; PCT Publication No. WO 99/28508). The complementarity of an antisense RNA may be with any part of the specific gene transcript, i.e., at the 5' non-coding sequence, 3' non-coding sequence, or the coding sequence. "Functional RNA" refers to antisense RNA, ribozyme RNA, or other RNA that is not translated and yet has an effect on cellular processes.

The term "operably linked" refers to the association of nucleic acid sequences on a single nucleic acid fragment so that the function of one is affected by the other. For example, a promoter is operably linked with a coding sequence when it is capable of affecting the expression of that coding sequence. That is, the coding sequence is under the transcriptional control of the promoter. Coding sequences can be operably linked to regulatory sequences in sense or antisense orientation.

The term "expression", as used herein, refers to the transcription and stable accumulation of sense (mRNA) or antisense RNA. Expression may also refer to translation of mRNA into a polypeptide.

"Mature" protein refers to a post-translationally processed polypeptide, i.e., one from which any pre- or propeptides present in the primary translation product have been removed. "Precursor" protein refers to the primary product of translation of mRNA, i.e., with pre- and propeptides still present. Pre- and propeptides may be, but are not limited to, intracellular localization signals.

The term "recombinase" refers to an enzyme(s) that carries out site-specific recombination to alter the DNA structure and includes transposases, lambda integration/excision enzymes, as well as site-specific recombinases.

"Recombinase site" or "site-specific recombinase sequence" means a DNA sequence that a recombinase will recognize and bind to. It will be appreciated that this may be a wild type or mutant recombinase site, as long as functionality is maintained and the recombinase enzyme may still recognize the site, bind to the DNA sequence, and catalyze the recombination between two adjacent recombinase sites.

"Transformation" refers to the transfer of a nucleic acid molecule into a host organism, resulting in genetically stable inheritance. The nucleic acid molecule may be a plasmid that replicates autonomously, for example, or, it may integrate into the genome of the host organism. Host organisms containing the transformed nucleic acid fragments are referred to as "transgenic" or "recombinant" or "transformed" organisms.

The terms "plasmid" and "vector" refer to an extra chromosomal element often carrying genes that are not part of the central metabolism of the cell, and usually in the form of circular double-stranded DNA fragments. Such elements may be autonomously replicating sequences, genome integrating sequences, phage or nucleotide sequences, linear or circular, of a single- or double-stranded DNA or RNA, derived from any source, in which a number of nucleotide sequences have been joined or recombined into a unique construction that is capable of introducing an expression cassette(s) into a cell.

The term "expression cassette" refers to a fragment of DNA comprising the coding sequence of a selected gene and regulatory sequences preceding (5' non-coding sequences) and following (3' non-coding sequences) the coding sequence that are required for expression of the selected gene product. Thus, an expression cassette is typically composed of: 1) a promoter sequence; 2) a coding sequence (i.e., ORF) and, 3) a 3' untranslated region (i.e., a terminator) that, in eukaryotes, usually contains a polyadenylation site. The expression cassette(s) is usually included within a vector, to facilitate cloning and transformation. Different expression cassettes can be transformed into different organisms including bacteria, yeast, plants and mammalian cells, as long as the correct regulatory sequences are used for each host.

The term "homologous recombination" refers to the exchange of DNA fragments between two DNA molecules (during cross over). The fragments that are exchanged are flanked by sites of identical nucleotide sequences between the two DNA molecules (i.e., "regions of homology"). The term "regions of homology" refer to stretches of nucleotide sequence on nucleic acid fragments that participate in homologous recombination that have homology to each other. Effective homologous recombination will generally take place where these regions of homology are at least about 10 bp in length, where at least about 50 bp in length is preferred. Typically fragments that are intended for recombination contain at least two regions of homology where targeted gene disruption or replacement is desired.

The term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., *J. Mol. Biol.,* 215:403-410 (1990)); 3) DNAS-TAR (DNASTAR, Inc. Madison, Wis.); 4) Sequencher (Gene Codes Corporation, Ann Arbor, Mich.); and, 5) the FASTA program incorporating the Smith-Waterman algorithm (W. R. Pearson, *Comput. Methods Genome Res.,* [Proc. Int. Symp.] (1994), Meeting Date 1992, 111-20. Editor(s): Suhai, Sandor. Plenum: New York, N.Y.). Within the context of this application it will be understood that where sequence analysis software is used for analysis, that the results of the analysis will be based on the "default values" of the program referenced, unless otherwise specified. As used herein "default values" will mean any set of values or parameters that originally load with the software when first initialized.

Standard recombinant DNA and molecular cloning techniques used herein are well known in the art and are described by Sambrook, J., Fritsch, E. F. and Maniatis. T., Molecular Cloning: A Laboratory Manual, $2^{nd}$ ed. Cold Spring Harbor Laboratory: Cold Spring Harbor, N.Y. (1989) (hereinafter "Maniatis"); by Silhavy. T. J., Bennan, M. L. and Enguist, L. W., Experiments with Gene Fusions, Cold Spring Harbor Laboratory: Cold Spring Harbor, N.Y. (1984); and by Ausubel, F. M. et al., Current Protocols in Molecular Biology, published by Greene Publishing Assoc. and Wiley-Interscience. Hoboken, N.J. (1987). An Overview: Microbial Biosynthesis Of Fatty Acids and Triacylglycerols In general, lipid accumulation in oleaginous microorganisms is triggered in response to the overall carbon to nitrogen ratio present in the growth medium. This process, leading to the de novo synthesis of free palmitate (16:0) in oleaginous microorganisms, is described in detail in U.S. Pat. No. 7,238, 482. Palmitate is the precursor of longer-chain saturated and unsaturated fatty acid derivates, which are formed through the action of elongases and desaturases (FIG. 1A and FIG. 1B).

TAGs, the primary storage unit for fatty acids, are formed by a series of reactions that involve: 1) the esterification of one molecule of acyl-CoA to glycerol-3-phosphate via an acyltransferase to produce lysophosphatidic acid; 2) the esterification of a second molecule of acyl-CoA via an acyltransferase to yield 1,2-diacylglycerol phosphate, commonly identified as phosphatidic acid; 3) removal of a phosphate by phosphatidic acid phosphatase to yield 1,2-diacylglycerol ["DAG"]; and, 4) the addition of a third fatty acid by the action of an acyltransferase to form TAG.

A wide spectrum of fatty acids can be incorporated into TAGs, including saturated and unsaturated fatty acids and short-chain and long-chain fatty acids. Some non-limiting examples of fatty acids that can be incorporated into TAGs by acyltransferases include: capric (10:0), lauric (12:0), myristic (14:0), palmitic (16:0), palmitoleic (16:1), stearic (18:0), oleic (18:1), vaccenic (18:1), LA, eleostearic (18:3), ALA, GLA, arachidic (20:0), EDA, ETrA, DGLA, ETA, ARA, EPA, behenic (22:0), DPA, DHA, lignoceric (24:0), nervonic (24:1), cerotic (26:0) and montanic (28:0) fatty acids. In the methods and host cells described herein, incorporation of EPA into TAG is most desirable.

Although most PUFAs are incorporated into TAGs as neutral lipids and are stored in lipid bodies, it is important to note that a measurement of the total PUFAs within an oleaginous organism should include those PUFAs that are located in the phosphatidylcholine fraction, phosphatidyl-etanolamine fraction, and triacylglycerol, also known as the TAG or oil, fraction.

Optimized Biosynthesis of EPA, an ω-3 Fatty Acid

The metabolic process wherein oleic acid is converted to EPA involves elongation of the carbon chain through the addition of carbon atoms and desaturation of the molecule through the addition of double bonds. This requires a series of special desaturation and elongation enzymes present in the endoplasmic reticulim membrane. However, as seen in FIG. 1A and FIG. 1B and as described below, multiple alternate pathways exist for EPA production.

Specifically, FIG. 1A and FIG. 1B depict the pathways described below. All pathways require the initial conversion of oleic acid to linoleic acid ["LA"], the first of the ω-6 fatty acids, by a Δ12 desaturase. Then, using the "Δ9 elongase/Δ8 desaturase pathway" and LA as substrate, long-chain ω-6 fatty acids are formed as follows: 1) LA is converted to eicosadienoic acid ["EDA"] by a Δ9 elongase; 2) EDA is converted to dihomo-γ-linolenic acid ["DGLA"] by a Δ8 desaturase; 3) DGLA is converted to arachidonic acid ["ARA"] by a Δ5 desaturase; 4) ARA is converted to docosatetraenoic acid ["DTA"] by a $C_{20/22}$ elongase; and, 5) DTA is converted to docosapentaenoic acid ["DPAn-6"] by a Δ4 desaturase.

The "Δ9 elongase/Δ8 desaturase pathway" can also use α-linolenic acid ["ALA"] as substrate to produce long-chain ω-3 fatty acids as follows: 1) LA is converted to ALA, the first of the ω-3 fatty acids, by a Δ15 desaturase; 2) ALA is converted to eicosatrienoic acid ["ETrA"] by a Δ9 elongase; 3) ETrA is converted to eicosatetraenoic acid ["ETA"] by a Δ8 desaturase; 4) ETA is converted to eicosapentaenoic acid ["EPA"] by a Δ5 desaturase; 5) EPA is converted to docosapentaenoic acid ["DPA"] by a $C_{20/22}$ elongase; and, 6) DPA is converted to docosahexaenoic acid ["DHA"] by a Δ4 desaturase. Optionally, ω-6 fatty acids may be converted to ω-3 fatty acids. For example, ETA and EPA are produced from DGLA and ARA, respectively, by Δ17 desaturase activity. Advantageously for the purposes herein, the Δ9 elongase/Δ8 desaturase pathway enables production of an EPA oil that lacks significant amounts of γ-linolenic acid ["GLA"].

Alternate pathways for the biosynthesis of ω-3/ω-6 fatty acids utilize a Δ6 desaturase and $C_{18/20}$ elongase, that is, the "Δ6 desaturase/Δ6 elongase pathway". More specifically, LA and ALA may be converted to GLA and stearidonic acid ["STA"], respectively, by a Δ6 desaturase; then, a $C_{18/20}$ elongase converts GLA to DGLA and/or STA to ETA.

A Preferred Microbial Host for EPA Production: *Yarrowia lipolytica*

It is contemplated that the particular functionalities required to be introduced into *Yarrowia lipolytica* for production of EPA will depend on the host cell and its native PUFA profile and/or desaturase/elongase profile, the availability of substrate, and the desired end product(s). With respect to the native host cell, it is known that *Y. lipolytica* can naturally produce 18:2 fatty acids and thus possesses a native Δ12 desaturase (SEQ ID NOs:1 and 2; see U.S. Pat. No. 7,214, 491).

As described in PCT Publication No. WO 2006/052870, creation of a recombinant *Yarrowia lipolytica* strain capable of producing high concentrations of EPA without co-synthesis of GLA minimally requires expression of the following genes: a Δ9 elongase, a Δ8 desaturase, a Δ5 desaturase and either a Δ17 desaturase or a Δ15 desaturase (or both), wherein at least one of the following genes could optionally be additionally expressed: a Δ9 desaturase, a Δ12 desaturase, a $C_{14/16}$ elongase and a $C_{16/18}$ elongase. Considerations presented therein for choosing a specific polypeptide having desaturase or elongase activity included: 1) the substrate specificity of the polypeptide; 2) whether the polypeptide or a component thereof was a rate-limiting enzyme; 3) whether the desaturase or elongase was essential for synthesis of the desired PUFA; 4) co-factors required by the polypeptide; 5) whether the polypeptide was modified after its production, such as by a kinase or a prenyltransferase; and/or, 6) the conversion efficiency of each particular desaturase and/or elongase.

In the present Application, wherein optimized strains of recombinant *Yarrowia lipolytica* are created having the ability to produce e.g., from 14% to greater than 53.2% EPA in the total lipid fraction, the strains minimally comprise the following genes of the ω-3/ω-6 fatty acid biosynthetic pathway:

a) at least one gene encoding Δ9 elongase; and,
　b) at least one gene encoding Δ8 desaturase; and,
　c) at least one gene encoding Δ5 desaturase; and,
　d) at least one gene encoding Δ17 desaturase; and,
　e) at least one gene encoding Δ12 desaturase; and,
　f) at least one gene encoding $C_{16/18}$ elongase.

More preferred, the recombinant *Yarrowia lipolytica* strain additionally comprises at least one gene encoding diacylglycerol cholinephosphotransferase (CPT1). Most preferred, the recombinant *Y. lipolytica* strain additionally comprises at least one gene encoding Δ15 desaturase; and/or at least one gene encoding Δ9 desaturase. Additional aspects of the elements required in an optimized strain of *Y. lipolytica* capable of high-level EPA production are elaborated below, wherein the optimized strains will produce at least about 25% EPA in the total lipids, preferably at least about 30% EPA in the total lipids, more preferably at least about 35% EPA in the total lipids, more preferably at least about 40% EPA in the total lipids, more preferably at least about 40-45% EPA in the total lipids, more preferably at least about 45-50% EPA in the total lipids, more preferably at least about 50-60%, and most preferably at least about 60-70% EPA in the total lipids of the recombinant *Yarrowia lipolytica* host cell.

In alternate embodiments, the optimized recombinant *Y. lipolytica* strains described herein will produce a microbial oil that comprises at least about 25% EPA in the total lipids and that contains less than about 1% GLA in the total lipids and that is devoid of any DHA.

In another embodiment, the optimized recombinant *Y. lipolytica* strains described herein will produce a microbial oil that comprises at least about 30% EPA in the total lipids and that contains less than about 25% LA in the total lipids.

In one preferred embodiment, the optimized recombinant *Y. lipolytica* strains described herein will produce at least about 12% microbial oil with respect to the dry cell weight.

In another preferred embodiment, the optimized recombinant *Y. lipolytica* strains described herein will produce at least about 50% ω-3 PUFAs as a percent of the total fatty acids.

Preferred Desaturase and Elongase Genes for Optimized EPA Biosynthesis

The Applicants have performed considerable analysis of various Δ9 elongases, Δ8 desaturases, Δ5 desaturases, Δ17 desaturases, Δ12 desaturases and $C_{16/18}$ elongases, to determine those enzymes having optimal substrate specificity and/or substrate selectivity when expressed in *Yarrowia lipolytica*. Based on these analyses, the genes and codon-optimized genes derived therefrom, described in Table 4, are identified herein as preferred for expression in *Y. lipolytica* for construction of an ω-3/ω-6 fatty acid biosynthetic pathway that enables high-level EPA biosynthesis. Additional details relating to each gene is elaborated infra.

As shown in Table 4, infra, many of the preferred EPA biosynthetic genes described have been codon-optimized for expression in *Yarrowia lipolytica*, as described in U.S. Pat. No. 7,125,672. As is well known to one of skill in the art, the expression of heterologous genes can be enhanced by increasing the translational efficiency of encoded mRNAs by replacement of codons in the native gene with those for optimal gene expression in the selected host microorganism. Additionally, to include an efficient yeast translation initiation sequence and obtain optimal gene expression, the nucleotide sequences surrounding the translational initiation codon 'ATG' of the synthetic, codon-optimized genes were frequently altered to include the following consensus sequence around the 'ATG' initiation codon: 'MAMMATGNHS' (SEQ ID NO:3), wherein the nucleic acid degeneracy code used is as follows: M=A/C; S=C/G; H=A/C/T; and N=A/C/G/T.

TABLE 4

Preferred Desaturases And Elongases For EPA Biosynthesis In *Yarrowia lipolytica*

| ORF | Organism | Co-pending Patent Application References | Wildtype Abbreviation and SEQ ID NO | Codon-Optimized Abbreviation and SEQ ID NO | Mutant Abbreviation and SEQ ID NO |
|---|---|---|---|---|---|
| Δ9 elongase | *Euglena gracillis* | Patent Publication US 2007-0117190 A1; PCT Publication No. WO 2007/061742 | "EgD9e" (SEQ ID NOs: 4 and 5) | "EgD9eS" (SEQ ID NOs: 6 and 7) | — |
|  | *Eutreptiella* sp. CCMP389 | Patent Publication US 2007-0117190 A1; PCT Publication No. WO 2007/061742 | "E389D9e" (SEQ ID NOs: 8 and 9) | "E389D9eS" (SEQ ID NOs: 10 and 11) | — |
|  | *Euglena anabaena* UTEX 373 | U.S. patent application Ser. No. 12/102,879 (filed Apr. 15, 2008) | "EaD9e"* (SEQ ID NOs: 12 and 13) | "EaD9eS" (SEQ ID NOs: 14 and 15) | — |
| Δ8 desaturase | *Euglena gracilis* | U.S. Pat. No. 7,256,033; Patent Publication US 2008-0138868 A1 | "EgD8"* (SEQ ID NOs: 18 and 19) | "EgD8S"* (SEQ ID NOs: 20 and 21) | "EgD8M"* (SEQ ID NOs: 22 and 23) |
|  | *Euglena anabaena* UTEX 373 | U.S. patent application Ser. No. 12/099,811 (filed Apr. 09, 2008) | "EaD8"* (SEQ ID NOs: 24 and 25) | "EaD8S" (SEQ ID NOs: 26 and 27) | — |
| Δ5 desaturase | *Euglena gracilis* | PCT Publication No. WO 2007/136671; U.S. patent application Ser. No. 61/098,333 (filed Sep. 18, 2008) | "EgD5" (SEQ ID NOs: 34 and 35) | "EgD5S" (SEQ ID NOs: 36 and 37) | "EgD5S-HXGG", comprising either a HGGG or a HHGG motif (SEQ ID NO: 122); and "EgD5S-HPGS", comprising a HPGS motif (SEQ ID NO: 124) |
|  | *Peridinium* sp. CCMP626 | PCT Publication No. WO 2007/136646; U.S. patent application Ser. No. 61/098,333 (filed Sep. 18, 2008) | "RD5" (SEQ ID NOs: 38 and 39) | "RD5S" (SEQ ID NOs: 40 and 41) | "RD5S-HXGG", comprising either a HCGG or a HWGG motif (SEQ ID NO: 126) |
|  | *Euglena anabaena* UTEX 373 | U.S. patent application Ser. No. 12/111,237 (filed Apr. 29, 2008); U.S. patent application Ser. No. 61/098,333 (filed Sep. 18, 2008) | "EaD5"* (SEQ ID NOs: 42 and 43) | "EaD5S"* (SEQ ID NOs: 44 and 45) | "EaD5S-HCGG", comprising a HCGG motif (SEQ ID NO: 125) |
| Δ17 desaturase | *Phytophthora ramorum* | PCT Publication No. WO 2007/123999; PCT Publication No. WO 2008/054565 | "PrD17" (SEQ ID NOs: 46 and 47) | "PrD17S" (SEQ ID NOs: 48 and 49) | — |
|  | *Pythium aphanidernatum* | PCT Publication No. WO 2008/054565 | "PaD17" (SEQ ID NOs: 50 and 51) | "PaD17S" (SEQ ID NOs: 52 and 53) | — |
| Δ12 desaturase | *Fusarium moniliforme* | Patent Publication US 2005-0216975 A1; PCT Publication No. WO 2005/047485 | "FmD12"* (SEQ ID NOs: 54 and 55) | "FmD12S" (SEQ ID NOs: 56 and 57) | — |
| $C_{16/18}$ elongase | *Mortierella alpina* | Patent Publication US 2007-0087420 A1; PCT Publication No. WO 2007/046817 | "ELO3" (SEQ ID NOs: 58 and 59) | "ME3S" (SEQ ID NOs: 60 and 61) | — |
| Δ15 | *Fusarium* | Patent Publication US 2005- | "FmD15"* | "FmD15S" | — |

TABLE 4-continued

Preferred Desaturases And Elongases For EPA Biosynthesis In *Yarrowia lipolytica*

| ORF | Organism | Co-pending Patent Application References | Wildtype Abbreviation and SEQ ID NO | Codon-Optimized Abbreviation and SEQ ID NO | Mutant Abbreviation and SEQ ID NO |
|---|---|---|---|---|---|
| desaturase | *moniliforme* | 0132442 A1; PCT Publication No. WO 2005/047480 | (SEQ ID NOs: 62 and 63) | (SEQ ID NOs: 64 and 65) | |
| Δ9 desaturase | *Yarrowia lipolytica* | — | "YID9" (SEQ ID NOs: 66 and 67) | — | — |

*Notes:
EaD9e was identified as "EaD9EIo1" in U.S. patent application Ser. No. 12/102,879; a variant Δ9 elongase from *Euglena anabaena* UTEX 373 was identified therein as "EaD9EIo2" (SEQ ID NOs: 16 and 17).
EgD8 was identified as "Eg5" in U.S. Pat. No. 7,256,033.
EgD8S was identified as "D8SF" in U.S. Pat. No. 7,256,033.
EgD8M was identified as "EgD8S-23" in Patent Publication US 2008-0138868 A1.
EaD8 was identified as "EaD8Des3" in U.S. patent application Ser. No. 12/099,811; variant Δ8 desaturases from *Euglena anabaena* UTEX 373 were identified therein as "EaD8Des1" (SEQ ID NOs: 28 and 29), "EaD8Des2" (SEQ ID NOs: 30 and 31) and "EaD8Des4" (SEQ ID NOs: 32 and 33).
EaD5 was identified as "EaD5Des1" in U.S. patent application Ser. No. 12/111,237.
FmD12 was identified as "Fm2" in Patent Publication US 2005-0216975 A1 and PCT Publication No. WO 2005/047485.
FmD15 was identified as "Fm1" in Patent Publication US 2005-0132442 A1 and PCT Publication No. WO 2005/047480.

At Least One Gene Encoding A Δ9 Elongase For Conversion Of LA To EDA And/Or ALA To ETrA: A Δ9 elongase from *Euglena gracilis* was isolated and characterized in Patent Publication US 2007-0117190 A1 and PCT Publication No. WO 2007/061742. Designated therein as EgD9e, the coding region is 777 bp long (SEQ ID NO:4) and encodes a protein of 258 amino acids (SEQ ID NO:5). As described in the cited publications, the Δ9 elongase activity of EgD9e was compared to a synthetic Δ9 elongase gene ["IgD9eS"] derived from *Isochrysis galbana* (IgD9e; NCBI Accession No. AAL37626 [GI 17226123], locus AAL37626, CDS AF390174; GenBank Accession No. AF390174) (CDS=nucleotides 2-793)) and codon-optimized for expression in *Yarrowia lipolytica*. EgD9e functioned with greater substrate conversion efficiency than IgD9eS, when converting LA to EDA (10.0% versus 6.9%).

Codon-optimization of EgD9e resulted in created of EgD9eS (SEQ ID NO:6). In addition to modification of the translation initiation site, 117 bp of the 777 bp coding region were modified (15.1%) and 106 codons were optimized (yet the protein sequence encoded by the codon-optimized gene [i.e., SEQ ID NO:7] is identical to that of the wildtype protein sequence [i.e., SEQ ID NO:5]). EgD9eS was about 16.2% more efficient elongating LA to EDA than the wildtype EgD9e when expressed in *Yarrowia lipolytica*.

The isolation and characterization of the *Eutreptiella* sp. CCMP389 Δ9 elongase is also described in Patent Publication US 2007-0117190 A1 and PCT Publication No. WO 2007/061742. The E389D9e coding region is 792 bp long (SEQ ID NO:8) and encodes a protein of 263 amino acids (SEQ ID NO:9). The E389D9e and EgD9e protein sequences share 65.1% identity using a Clustal V method of analysis (Higgins, D. G. and Sharp, P. M., *Comput. Appl. Biosci.*, 5:151-153 (1989); Higgins et al., *Comput. Appl. Biosci.*, 8:189-191 (1992)) using the MegAlign™ v6.1 program of the LASERGENE bioinformatics computing suite (DNASTAR Inc., Madison, Wis.) with default parameters for pairwise alignment (KTUPLE=1, GAP PENALTY=3, WINDOW=5 and DIAGONALS SAVED=5 and GAP LENGTH PENALTY=10). E389D9e converted about 11% LA to EDA when expressed in *Yarrowia lipolytica*.

Codon-optimization of E389D9e resulted in modification of 128 bp of the 792 bp coding region (16.2%) and optimization of 113 codons. This increased the GC content from 45.7% within E389D9e to 50.1% within E389D9eS (SEQ ID NO:10). The protein sequence encoded by the codon-optimized gene (i.e., SEQ ID NO:11) is identical to that of the wildtype protein sequence (i.e., SEQ ID NO:9). E389D9eS elongated 12% LA to EDA, when expressed in *Yarrowia lipolytica*.

Most recently, the isolation and characterization of the *Euglena anabaena* UTEX 373 Δ9 elongase (EaD9e) was described in U.S. patent application Ser. No. 12/102,879 (and designated therein as EaD9EIo1). The EaD9e coding region is 774 bp (SEQ ID NO:12) and encodes a protein of 258 amino acids (SEQ ID NO:13). EaD9e shares 32.9% sequence identity with IgD9e and 77.1% sequence identity with EgD9e, according to the Clustal V method of analysis (supra) using the MegAlign™ v6.1 program of the LASERGENE bioinformatics computing suite (DNASTAR Inc.) with default parameters for pairwise alignment (supra). Upon expression of EaD9e in *Yarrowia lipolytica*, an average of 22.7% Δ9 elongation was reported based on the following formula: ([EDA]/[LA+EDA])*100. Subsequent expression of EaD9e in *Y. lipoytica* in an alternate cloning vector in the Applicant's laboratory resulted in 12% Δ9 elongation.

In addition to modification of the translation initiation site, 106 bp of the 774 bp EaD9e coding region were modified (13.7%) and 98 codons were optimized (38.0%) during synthesis of EaD9eS (SEQ ID NO:14). The protein sequence encoded by the codon-optimized gene (i.e., SEQ ID NO:15) is identical to that of the wildtype protein sequence (i.e., SEQ ID NO:13). EaD9eS elongated 13% LA to EDA, when expressed in *Y. lipolytica*.

At Least One Gene Encoding A Δ8 Desaturase For Conversion Of EDA To DGLA And/Or ETrA To ETA: Several Δ8 desaturases isolated and derived from *Euglena gracilis* are preferred herein. U.S. Pat. No. 7,256,033 discloses a *E. gracilis* Δ8 desaturase able to desaturate EDA and EtrA (designated therein as "Eg5"). Although 100% identical and functionally equivalent to the nucleotide and amino acid sequences of Eg5, the wildtype *E. gracilis* Δ8 desaturase will be referred to herein as "EgD8". The EgD8 coding region is 1263 bp long (i.e., nucleotides 4-1269 of SEQ ID NO:18) and encodes a protein of 421 amino acids (SEQ ID NO:19).

U.S. Pat. No. 7,256,033 also discloses a synthetic Δ8 desaturase derived from EgD8 and codon-optimized for expression in *Yarrowia lipolytica* (designated therein as "D8SF"). Although 100% identical and functionally equivalent to the nucleotide and amino acid sequences of D8SF, the codon-optimized *E. gracilis* Δ8 desaturase will be referred to herein as "EgD8S" (SEQ ID NOs:20 and 21). Specifically, 207 bp (16.4%) of the 1263 bp coding region of EgD8 were modified, corresponding to codon-optimization of 192 codons. Additionally, EgD8S had one additional valine amino acid inserted between amino acid residues 1 and 2 of the wildtype EgD8; thus, the total length of EgD8S is 422 amino acids (SEQ ID NO:21). Expression of EgD8S in *Y. lipolytica* demonstrated more efficient desaturation of EDA to DGLA than EgD8.

Despite the usefulness of EgD8 and EgD8S, a synthetically engineered mutant Δ8 desaturase identified herein as EgD8M (SEQ ID NOs:22 and 23) is preferentially used in the engineered strains of *Yarrowia* described herein. As elaborated in Patent Publication US 2008-0138868 A1, EgD8M (identified therein as "EgD8S-23") was created by making multiple rounds of targeted mutations within EgD8S. The effect of each mutation on the Δ8 desaturase activity of the resulting mutant was screened to ensure functional equivalence with the Δ8 desaturase activity of EgD8S (SEQ ID NO:21). As a result of this work, mutant EgD8M (SEQ ID NO:23) comprises the following 24 amino acid mutations with respect to the synthetic codon-optimized EgD8S sequence set forth as SEQ ID NO:21: 4S to A, 5K to S, 12T to V, 16T to K, 17T to V, 66P to Q, 67S to A, 108S to L, 117G to A, 118Y to F, 120L to M, 121M to L, 125Q to H, 126M to L, 132V to L, 133 L to V, 162L to V, 163V to L, 293L to M, 407A to S, 408V to Q, 418A to G, 419G to A and 422L to Q. Pairwise alignment of the EgD8M and EgD8S protein sequences using default parameters of Vector NTI®'s AlignX program (Invitrogen Corporation, Carlsbad, Calif.) revealed 94.3% sequence identity and 97.9% consensus between the two proteins over a length of 422 amino acids.

Most recently, the isolation and characterization of the *Euglena anabaena* UTEX 373 Δ8 desaturase ("EaD8") was described in U.S. patent application Ser. No. 12/099,811 (identified therein as "EaD8Des3"). The EaD8 coding region is 1260 bp long (SEQ ID NO:24) and encodes a protein of 420 amino acids (SEQ ID NO:25). EaD8 shares 71.9% sequence identity with EgD8, based on a Clustal V method of analysis (supra) using the MegAlign™ v6.1 program of the LASERGENE bioinformatics computing suite (DNASTAR Inc.) with default parameters for pairwise alignment (supra). Upon expression of EaD8 in *Yarrowia lipoytica*, an average of 52.3% C20 desaturation was reported when the enzyme was presented with DGLA as substrate, while an average of 45.5% C20 desaturation was reported when the enzyme was presented with ETrA as substrate.

Following confirmation of the Δ8 desaturase activity of EaD8, EaD8S (SEQ ID NO:26) was designed based on the coding sequence of EaD8. In addition to modification of the translation initiation site, 231 bp of the 1260 bp coding region were modified (18.3%) and 208 codons were optimized (49.5%). The GC content was reduced from 56.8% within EaD8 to 54.8% within EaD8S. The protein sequence encoded by the codon-optimized gene (i.e., SEQ ID NO:27) is identical to that of the wildtype protein sequence (i.e., SEQ ID NO:25).

At Least One Gene Encoding A Δ5 Desaturase For Conversion Of DGLA To ARA And/Or ETA To EPA: A Δ5 desaturase from *Euglena gracilis* (i.e., EgD5) was isolated and characterized in PCT Publication No. WO 2007/136671. The 1350 bp coding region of EgD5, set forth as SEQ ID NO:34, encodes a protein of 449 amino acids (SEQ ID NO:35) which converts DGLA to ARA, with an average conversion efficiency of about 33%.

The Δ5 desaturase activity of EgD5 was compared to the well-characterized *Mortierella alpina* Δ5 desaturase (i.e., "MaD5"; U.S. Pat. No. 6,075,183 and PCT Publications No. WO 2004/071467 and No. WO 2005/047479), upon expression in *Yarrowia lipolytica*. EgD5 was approximately 2.6- to 2.9-fold more active in *Y. lipolytica* than MaD5 when DGLA, EDA and ETA were used as substrates, although the desaturases had approximately the same activity on ETrA (activity calculated by dividing the % Δ5 desaturation for EgD5 on a particular substrate by the % Δ5 desaturation for MaD5 on the same substrate). The substrate specificity of EgD5 and MaD5 for DGLA (versus EDA) was approximately the same in *Yarrowia* but there was an approximate 2.5-fold preference of EgD5 for ETA (versus ETrA) over MaD5; substrate specificity was calculated by dividing the % Δ5 desaturation for DGLA or ETA by the % Δ5 desaturation for EDA or ETrA, respectively. EgD5 also had a preference for ω-6 substrates (i.e., EDA and DGLA) over the ω-3 substrates (i.e., ETrA and ETA), respectively. Despite these results, some variation in activity of EgD5 may be observed when using the in vivo substrate; further experimentation may be required.

Codon-optimization of EgD5 resulted in modification of 196 bp of the 1350 bp coding region (14.5%) and optimization of 189 codons of the total 449 codons (42%). The protein sequence encoded by the codon-optimized EgD5S gene (i.e., SEQ ID NO:37) is identical to that of the wildtype protein sequence (i.e., SEQ ID NO:35). The codon-optimized gene identified as EgD5S (SEQ ID NO:36) was 36% more efficient desaturating DGLA to ARA than the wildtype gene, when expressed in *Y. lipolytica*.

The *Peridinium* sp. CCMP626 Δ5 desaturase (RD5) was isolated and characterized in PCT Publication No. WO 2007/136646. The 1392 bp coding sequence of RD5 is set forth in SEQ ID NO:38, while the encoded protein is 463 amino acids (SEQ ID NO:39). This Δ5 desaturase converts DGLA to ARA in *Yarrowia lipolytica* with about 35% (average) conversion efficiency. RD5 was also compared to the *Mortierella alpina* Δ5 desaturase (MaD5; supra). RD5 is approximately 3.0- to 9.7-fold more active in *Yarrowia* than MaD5 when DGLA, EDA, ETrA and ETA are used as substrates. The substrate specificity of RD5 compared to MaD5 for the correct ω-6 substrate (i.e., DGLA versus EDA) is approximately 0.4 and for the ω-3 substrate (i.e., ETA versus ETrA) is approximately 0.6. RD5 also has an approximate 1.4-fold preference for ω-6 substrates (i.e., EDA and DGLA) over the ω-3 substrates (i.e., ETrA and ETA), respectively. As with EgD5, some variation in activity of RD5 may be observed when using the in vivo substrate; further experimentation may be required.

Codon optimization of RD5 resulted in modification of 247 bp of the 1392 bp coding region (17.7%) and optimization of 229 codons (49.4%), in addition to modification of the translation initiation site. The GC content was increased from 49.3% within RD5 to 54.2% within the synthetic gene (i.e., RD5S). A NcoI site and NotI sites were incorporated around the translation initiation codon and after the stop codon of RD5S (SEQ ID NO:40), respectively. The protein sequence encoded by the codon-optimized gene (i.e., SEQ ID NO:41) is identical to that of the wildtype protein sequence (i.e., SEQ ID NO:39). RD5S was about 8.9% more efficient converting DGLA to ARA than the wild type RD5.

The *Euglena anabaena* UTEX 373 Δ5 desaturase (EaD5) was isolated and characterized in U.S. patent application Ser. No. 12/111,237 (identified therein as EaD5Des1). The coding region is 1362 bp (SEQ ID NO:42) and encodes a protein of 454 amino acids (SEQ ID NO:43), which shares 77.1% sequence identity with EgD5 according to the Clustal V method of analysis (supra) using the MegAlign™ v6.1 program of the LASERGENE bioinformatics computing suite (DNASTAR Inc.) with default parameters for pairwise alignment (supra). EaD5 was demonstrated to have Δ5 desaturase activity, with an approximately 3.5-fold preference for DGLA or ETA over EDA or ETrA, respectively. Furthermore, EaD5 prefers ω-6 substrates over ω-3 substrates.

Following confirmation of the Δ5 desaturase activity of EaD5, EaD5S (SEQ ID NO:44) was designed based on the coding sequence of EaD5. In addition to modification of the translation initiation site, 183 bp of the 1362 bp coding region were modified (13.4%) and 174 codons were optimized (38.3%). The GC content was reduced from 57.6% within the wild type gene (i.e., EaD5) to 54.6% within EaD5S. A NcoI site and NotI sites were incorporated around the translation initiation codon and after the stop codon of EaD5S (SEQ ID NO:44), respectively. The protein sequence encoded by the codon-optimized gene (i.e., SEQ ID NO:45) is identical to that of the wildtype protein sequence (i.e., SEQ ID NO:43).

Most recently, U.S. Provisional Patent Application No. 61/098,333 (incorporated herein by reference) describes mutant Δ5 desaturases that possess improved enzymatic activity with respect to their EgD5S, EaD5S and RD5S counterparts, when heterologously expressed in *Yarrowia lipolytica*. Although Δ5 desaturases contain several conserved sequences (i.e., three histidine boxes [SEQ ID NOs:190-195] and the cytochrome b₅ domain), the heme-binding motif (i.e., His-Pro-Gly-Gly or HPGG; SEQ ID NO:182) was selected as a target for mutational studies. Results demonstrated that neither the proline residue nor the second glycine residue of the HPGG motif in EgD5S, EaD5S or RD5S were essential for Δ5 desaturase function. More surprisingly, however, was the identification of several mutant enzymes having increased Δ5 desaturase activity with respect to the non-mutated desaturase. EgD5S-HXGG (SEQ ID NO:122) had either a HGGG (SEQ ID NO:185) motif and 104.6% Δ5 desaturase activity as compared to EgD5S or a HHGG (SEQ ID NO:186) motif and 103.6% Δ5 desaturase activity as compared to EgD5S. EgD5S-HPGS (SEQ ID NO:124), comprising a HPGS (SEQ ID NO:187) motif, had 106.9% Δ5 desaturase activity as compared to EgD5S. RD5S-HXGG (SEQ ID NO:126) had either a HCGG (SEQ ID NO:188) motif and 138.6% Δ5 desaturase activity as compared to RD5S, or a HWGG (SEQ ID NO:189) motif and 113.5% Δ5 desaturase activity as compared to RD5S (although RD5S-HXGG results are based on initial assay results and not quantitative analysis). And, EaD5S-HCGG (SEQ ID NO:125), comprising a HCGG (SEQ ID NO:188) motif, demonstrated 107.9% Δ5 desaturase activity as compared to EaD5S. Preferred mutant Δ5 desaturases have the nucleic acid sequences set forth as SEQ ID NO:196 (corresponding to the amino acid sequence set forth as SEQ ID NO:122), SEQ ID NO:197 (corresponding to the amino acid sequence set forth as SEQ ID NO:122), SEQ ID NO:198 (corresponding to the amino acid sequence set forth as SEQ ID NO:124), SEQ ID NO:199 (corresponding to the amino acid sequence set forth as SEQ ID NO:125), SEQ ID NO:200 (corresponding to the amino acid sequence set forth as SEQ ID NO:126) and SEQ ID NO:201 (corresponding to the amino acid sequence set forth as SEQ ID NO:126).

At Least One Gene Encoding A Δ17 Desaturase For Conversion Of ARA To EPA And/Or DGLA To ETA: U.S. patent application Ser. No. 11/787,772 provides details concerning the isolation and characterization of the *Phytophthora ramorum* Δ17 desaturase ("PrD17"). PrD17 is an enzyme of 361 amino acids (SEQ ID NO:47), encoded by the 1086 bp ORF set forth in SEQ ID NO:46. PrD17 was optimized for expression in *Yarrowia lipolytica*; specifically, 168 bp of the coding region were modified (15.5%) and 160 codons were optimized (44.2%), in addition to modification of the translation initiation site. The GC content was reduced from 64.4% within PrD17 to 54.5% within the synthetic gene (i.e., PrD17S). A NcoI site and NotI sites were incorporated around the translation initiation codon and after the stop codon of PrD17S (SEQ ID NO:48), respectively. The protein sequence encoded by the codon-optimized gene (i.e., SEQ ID NO:49) is identical to that of the wildtype protein sequence (i.e., SEQ ID NO:47).

Upon expression of PrD17S in *Yarrowia lipolytica*, ARA was converted into EPA at an average rate of about 49%. Further analysis of the substrate specificity of PrD17S in U.S. patent application Ser. No. 11/779,915 also determined that PrD17S could utilize EDA and DGLA as effective substrates, resulting in greater than 25% conversion efficiency with each.

The Δ17 desaturase from *Pythium aphanidermatum* was isolated and characterized in U.S. patent application Ser. No. 11/779,915. The PaD17 coding region is 1080 bp long (SEQ ID NO:50) and encodes a protein of 359 amino acids (SEQ ID NO:51). Pairwise comparison between and among Δ17 desaturase proteins from *Phytophthora infestans* (PiD17; GenBank Accession No. CAJ30870; PCT Publication No. WO 2005/083053), *Phytophthora sojae* (PsD17; PCT Publication No. WO 2006/100241; PCT Publication No. WO 2007/123999), *Phytophthora ramorum* (PrD17; SEQ ID NO:47; supra) and PaD17 using a Clustal W analysis (described by Higgins and Sharp, *CABIOS*, 5:151-153 (1989); Higgins, D. G. et al., *Comput. Appl. Biosci.*, 8:189-191 (1992)) found in the MegAlign™ v6.1 program of the LASERGENE bioinformatics computing suite (DNASTAR Inc.) with default parameters resulted in the following percent similarities: 74.5% between PiD17 and PaD17; 75.0% between PrD17 and PaD17; and 75.3% between PsD17 and PaD17.

Optimization of PaD17 resulted in modification of 188 bp of the 1080 bp coding region (including the stop codon) (17.4%) and optimization of 175 codons (48.6%), in addition to modification of the translation initiation site. The GC content was reduced from 61.8% within PaD17 to 54.5% within PaD17S (SEQ ID NO:52). A NcoI site and a NotI site were incorporated around the translation initiation codon and after the stop codon of PaD17S, respectively. The protein sequence encoded by the codon-optimized gene (i.e., SEQ ID NO:53) is identical to that of the wildtype protein sequence (i.e., SEQ ID NO:51). The conversion efficiency of PaD17S ranged between 54.1% to 55.6%, compared with 18.4% to 19.5% conversion efficiency for the wild-type PaD17.

The substrate specificity of PaD17S (SEQ ID NO:52) was further evaluated with respect to PsD17S (a synthetic Δ17 desaturase derived from PsD17 and codon-optimized for expression in *Yarrowia lipolytica*; U.S. patent application Ser. No. 11/787,772) and PrD17S (SEQ ID NO:48). Although all three Δ17 desaturases had the strongest preference for ARA, relatively lower activities on EDA and DGLA, and least activity on GLA, PaD17S was found to have the strongest overall activity on ARA. Additionally, PaD17S had significant Δ15 desaturase activity on the C18 substrate LA, wherein the activity was comparable to the Δ17 desaturase activity on the C20 substrates EDA and DGLA.

At Least One Gene Encoding A Δ12 Desaturase For Conversion Of Oleic Acid To LA: *Yarrowia lipolytica* possesses a native gene encoding a Δ12 desaturase ("YID12"; SEQ ID NOs:1 and 2), identified and characterized in U.S. Pat. No. 7,214,491. However, as described in PCT Publications No. WO 2005/047485 and No. WO 2006/052870, the *Fusarium moniliforme* Δ12 desaturase ("FmD12"; encoded by SEQ ID NOs:54 and 55) functions with greater efficiency than YID12 in producing 18:2 in *Y. lipolytica*. More specifically, although both Δ12 desaturases catalyze the conversion of oleic acid to LA, the two enzymes differ in their overall specificity (which thereby affects each enzyme's percent substrate conversion). FmD12 has a higher loading capacity of LA onto the sn-2 position of a phosphotidylcholine substrate than YID12. This was demonstrated when expression of FmD12 under the control of the translation elongation factor EF1-α promoter (TEF; U.S. Pat. No. 6,265,185) in *Y. lipolytica* was determined to produce higher levels of 18:2 (68% product accumulation of LA) than were previously attainable by expression of a chimeric gene encoding YID12 under the control of the TEF promoter (59% product accumulation of LA). This corresponds to a difference in percent substrate conversion (calculated as ([18:2+18:3]/[18:1+18:2+18:3])*100) of 85% versus 74%, respectively. On the basis of these results, expression of the fungal FmD12 is preferred relative to the native YID12 as a means to engineer a high EPA-producing strain of *Y. lipolytica*. Furthermore, overexpression of the FmD12 in conjunction with a knockout of YID12 may be particularly advantageous to facilitate Δ9 elongation of the product, LA.

Optimization of FmD12 resulted in modification of 182 bp of the 1434 bp coding region (12.7%) and optimization of 172 codons (36%), thereby yielding the gene set forth as FmD12S (SEQ ID NO:56). The protein sequence encoded by the codon-optimized FmD12S gene (i.e., SEQ ID NO:57) is identical to that of the wildtype protein sequence (i.e., SEQ ID NO:55).

At Least One Gene Encoding A $C_{16/18}$ Elongase For Conversion Of Palmitate To Stearic acid (18:0): Although *Yarrowia lipolytica* does possess a native $C_{16/18}$ elongase (identified as "YE2" and characterized in PCT Publication No. WO 2006/052870), a preferred $C_{16/18}$ elongase in the present Application is the *Mortierella alpina* $C_{16/18}$ elongase (ELO3). ELO3 (SEQ ID NO:59), an enzyme of 275 amino acids and encoded by the 828 bp ORF set forth in SEQ ID NO:58, was isolated and characterized in Patent Publication US 2007-0087420 A1 and PCT Publication No. WO 2007/046817. As described therein, ELO3 was over-expressed in *Yarrowia lipolytica* under the control of a strong native promoter (i.e., FBAIN), thereby resulting in transformants that produced 35% more C18 fatty acids (i.e., 18:0, C18:1, C18:2 and GLA) and 31% less C16 fatty acids than the control strains without ELO3. These data demonstrated that ELO3 uses C16 fatty acids as substrates to produce C18 fatty acids.

Optimization of ELO3 resulted in modification of 114 bp of the 828 bp coding region (13.8%) and optimization of 111 codons (40.2%), thereby producing the gene designated as ME3S (SEQ ID NO:60). The protein sequence encoded by the codon-optimized ME3S gene (i.e., SEQ ID NO:61) is identical to that of the wildtype protein sequence (i.e., SEQ ID NO:59).

At Least One Gene Encoding A Δ15 Desaturase For Conversion Of LA To ALA And/Or GLA To STA: The *Fusarium moniliforme* Δ15 desaturase (FmD15) described herein as SEQ ID NOs:62 and 63 is the preferred Δ15 desaturase for increasing the production of ALA. The enzyme comprises 402 amino acids, encoded by a 1209 bp coding sequence.

This particular Δ15 desaturase possesses several unique characteristics as compared to previously known Δ15 desaturases (PCT Publications No. WO 2005/047480 and No. WO 2006/052870). First, FmD15 is distinguished by its significant Δ12 desaturase activity (thus characterizing the enzyme as bifunctional). Previous studies have determined that a Δ12 desaturase-disrupted strain of *Yarrowia lipolytica* that was transformed with a chimeric gene encoding SEQ ID NO:62 was able to convert 24% of oleic acid to LA (percent substrate conversion calculated as ([18:2+18:3]/[18:1+18:2+18:3])*100), in addition to 96% of LA to ALA (percent substrate conversion calculated as [18:3]/[18:2+18:3]*100)). Secondly, FmD15 enables very high synthesis of ALA when expressed in *Y. lipolytica* [i.e., *Y. lipolytica* that was transformed with a chimeric gene encoding SEQ ID NO:62 was able to demonstrate 31% product accumulation of ALA, relative to the total fatty acids in the transformant host cell, which is equivalent to a conversion efficiency to ALA of 83% (calculated as [18:3]/[18:2+18:3]*100)], relative to that described for other heterologously expressed Δ15 desaturases. For example, the % product accumulation of ALA when expressing the *C. elegans* Δ15 desaturase in the non-oleaginous yeast *Sacchromyces cerevisiae* was only 4.1% (Meesapyodsuk et al., Biochem., 39:11948-11954 (2000)), while the % product accumulation of ALA when expressing the *B. napus* Δ15 desaturase in *S. cerevisiae* was only 1.3% (Reed., D. W. et al., Plant Physiol., 122:715-720 (2000)). Finally, FmD15 has relatively broad substrate specificity on downstream ω-6 derivatives of 18:2. Specifically, the Δ15 desaturase is able to catalyze conversion of GLA to STA, DGLA to ETA, and ARA to EPA.

Optimization of FmD15 resulted in modification of 135 bp of the 1209 bp coding region (11.2%) and optimization of 128 codons (31.8%), as set forth in the FmD15S gene of SEQ ID NO:64. The resulting FmD15S protein sequence encoded by the codon-optimized gene (i.e., SEQ ID NO:65) is identical to that of the wildtype protein sequence (i.e., SEQ ID NO:63).

At Least One Gene Encoding A Δ9 Desaturase For Conversion Of Palmitate To Palmitoleic Acid (16:1) And/Or Stearic Acid To Oleic Acid (18:1): Locus tag YALI0C05951g within the genomic sequence of *Yarrowia lipolytica* CLIB122 (GenBank Accession No. XM_501496) is identified as a *Yarrowia lipolytica* Δ9 desaturase. YID9 is an enzyme of 482 amino acids (SEQ ID NO:67), encoded by the 1449 bp ORF set forth in SEQ ID NO:66. When YID9 was over-expressed in *Yarrowia lipolytica* under the control of the YAT1 promoter, oil in the transformants increased about 6% as compared to the oil in a host cell transformed with a control DNA fragment.

Although sequences of preferred desaturase and elongase genes are presented that encode PUFA biosynthetic pathway enzymes suitable for EPA production in *Yarrowia lipolytica*, these genes are not intended to be limiting. Numerous other genes encoding PUFA biosynthetic pathway enzymes that would be suitable for the purposes herein could be isolated from a variety of sources, e.g., isolated from a natural source such as from bacteria, algae, fungi, plants, animals, etc., produced via a semi-synthetic route or synthesized de novo. Furthermore, an alternate enzyme could be a wildtype, codon-optimized, fusion, synthetic and/or mutant enzyme having appropriate desaturase or elongase activity. These alternate enzymes would be characterized by the ability to: 1) elongate LA to EDA and/or ALA to ETrA (Δ9 elongases); 2) catalyze the conversion of EDA to DGLA and/or ETrA to ETA (Δ8 desaturases); 3) catalyze the conversion of DGLA to ARA and/or ETA to EPA (Δ5 desaturases); 4) catalyze the conversion of ARA to EPA and/or DGLA to ETA (Δ17 desaturases); 5) catalyze the conversion of oleic acid to LA (Δ12 desaturases); 6) elongate a C16 substrate to produce a C18 product ($C_{16/18}$ elongases); 7) catalyze the conversion of LA to ALA (Δ15 desaturases); and/or, 8) catalyze the conversion of palmitate to palmitoleic acid and/or stearic acid to oleic acid (Δ9 desaturases).

Alternately, other DNAs which are substantially identical to the desaturases and elongases set forth in Table 4 can be used for production of EPA in *Yarrowia lipolytica*. By "substantially identical" is intended an amino acid sequence or nucleic acid sequence exhibiting in order of increasing preference at least 80%, 90% or 95% homology to the selected polypeptides, or nucleic acid sequences encoding the amino acid sequence. For polypeptides, the length of comparison sequences generally is at least 16 amino acids, preferably at least 20 amino acids or most preferably 35 amino acids. For nucleic acids, the length of comparison sequences generally is at least 50 nucleotides, preferably at least 60 nucleotides, more preferably at least 75 nucleotides, and most preferably 110 nucleotides.

Homology typically is measured using sequence analysis software, wherein the term "sequence analysis software" refers to any computer algorithm or software program that is useful for the analysis of nucleotide or amino acid sequences. "Sequence analysis software" may be commercially available or independently developed. Typical sequence analysis software will include, but is not limited to: 1) the GCG suite of programs (Wisconsin Package Version 9.0, Genetics Computer Group (GCG), Madison, Wis.); 2) BLASTP, BLASTN, BLASTX (Altschul et al., *J. Mol. Biol.*, 215:403-410 (1990)); 3) DNASTAR (DNASTAR, Inc., Madison, Wis.); and 4) the FASTA program incorporating the Smith-Waterman algorithm (W. R. Pearson, *Comput. Methods Genome Res.*, [Proc. Int. Symp.] (1994), Meeting Date 1992, 111-20. Suhai, Sandor, Ed. Plenum: New York, N.Y.). Within this description, whenever sequence analysis software is used for analysis, the analytical results are based on the "default values" of the program referenced, unless otherwise specified. As used herein "default values" will mean any set of values or parameters that originally load with the software when first initialized. In general, such computer software matches similar sequences by assigning degrees of homology to various substitutions, deletions, and other modifications.

Other DNAs which, although not substantially identical to the preferred desaturases and elongases presented in Table 4 also can be used for the purposes herein if said alternate desaturases and elongases function in substantially the same manner as the preferred desaturases and elongases described above.

It is contemplated that one skilled in the art could create a chimeric fusion protein having bifunctional or trifunctional activity. Thus, a chimeric fusion protein could be produced that has: both elongase and desaturase activities (e.g., a Δ9 elongase-Δ8 desaturase gene fusion, as described in U.S. patent application Ser. No. 12/061,738, filed Apr. 3, 2008); bi- or tri-elongase activities (e.g., a $C_{16/18}$ elongase-Δ9 elongase gene fusion); or, bi- or tri-desaturase activities (e.g., a Δ5 desaturase-Δ12 desaturase gene fusion). For example, a chimeric fusion protein having both Δ12 desaturase and Δ5 desaturase activities suitable for the purposes herein could be synthesized by fusing together a Δ12 desaturase and Δ5 desaturase with an adjoining linker. Either the Δ12 desaturase or the Δ5 desaturase could be at the N-terminal portion of the fusion protein. Means to design and synthesize an appropriate linker molecule are readily known by one of skill in the art, for example, the linker can be a stretch of alanine or lysine amino acids and will not affect the fusion enzyme's activity. Preferred desaturase and elongase genes that could be fused together would be selected from those described in Table 4, supra.

Finally, it is well known in the art that methods for synthesizing sequences and bringing sequences together are well established in the literature. Thus, in vitro mutagenesis and selection, site-directed mutagenesis, chemical mutagenesis, "gene shuffling" methods or other means can be employed to obtain mutations of naturally occurring desaturase and/or elongase genes, such as those described in Table 4. This would permit production of a polypeptide having desaturase or elongase activity, respectively, in vivo with more desirable physical and kinetic parameters for functioning in the host cell (e.g., a longer half-life or a higher rate of production of a desired PUFA).

Diacylglycerol Cholinephosphotransferase Expression for Optimized EPA Biosynthesis The optimized recombinant *Yarrowia lipolytica* strains described herein having the ability to produce e.g., greater than 25% EPA in the total lipids, minimally comprise a Δ9 elongase, a Δ8 desaturase, a Δ5 desaturase, a Δ17 desaturase, a Δ12 desaturase and a $C_{16/18}$ elongase. In addition to those desaturases and elongases, however, preferred strains of *Yarrowia lipolytica* additionally comprise at least one gene encoding a diacylglycerol cholinephosphotransferase ["CPT1"].

Diacylglycerol cholinephosphotransferase (EC 2.7.8.2) is an enzyme that catalyzes the following reaction within the CDP-choline pathway, responsible for phosphatidylcholine biosynthesis: CDP-choline+1,2-diacylglycerol=cytidine-5'-monophosphate (CMP)+a phosphatidylcholine. The diacylglycerol cholinephosphotransferase of *Yarrowia lipolytica* (YlCPT1) is set forth as GenBank Accession No. XM_501703 (YALI0C10989g); this enzyme of 394 amino acids (SEQ ID NO:69) is encoded by the 1185 bp coding sequence of SEQ ID NO:68. As described previously in WO 2006/052870, overexpression of YlCPT1 under the control of a strong *Yarrowia lipolytica* promoter was demonstrated to result in an increased percentage of EPA with respect to the total fatty acids in an EPA-producing strain, as compared to the parental strain whose native YlCPT1 was not overexpressed.

Preferred Gene Knockouts in an Optimized EPA Strain

In addition to the coordinated expression of various preferred desaturase, elongase and diacylglycerol cholinephosphotransferase genes (supra), it may be useful for the recombinant *Yarrowia* sp. to simultaneously lack various native enzymatic activities. This is often accomplished by targeted gene knockouts, accomplished during integration of linear DNA into the genome of the host. Not surprisingly, preferred knockouts include those useful for selection of transformants (e.g., orotidine-5'-phosphate decarboxylase [Ura3–], saccharopine dehydrogenase [Lys5–], isopropyl malate dehydrogenase [Leu2–]) and those that diminish fatty acid degradation and TAG degradation (e.g., acyl-CoA oxidase isozymes [POX1–, POX2–, POX3–, POX4– and POX5–], lipases [Lip1–, Lip2–, Lip3–, Lip4a–]). Other preferred gene knockouts are those that appear to result in a phenotypically "neutral" mutation, wherein the *Yarrowia* host cell seems unaffected (e.g., YALI0F24167g [GenBank Accession No. XM_505819], YALI0C18711g-[GenBank Accession No. XP_501987], SCP2– [YALI0E01298g; GenBank Accession No. XM_503410]). In contrast, some preferred gene knockouts have been demonstrated to result in increases in the total oil content and/or EPA as a percent of total fatty acids (e.g., diacylglycerol acyltransferase 2 [DGAT2–], peroxisomal biogenesis factor protein 3 [Pex3p–], peroxisomal biogenesis factor protein 10 [Pex10p–], peroxisomal biogenesis factor protein 16 [Pex16p–]). Each of these broad categories of gene knockouts will be described in additional detail below (the usefulness of a knockout of the *Y. lipolytica* Δ12 desaturase will not be reiterated below, as this reasoning was previously presented during description of the *F. moniliforme* Δ12 desaturase).

It is important to note that despite the exemplary SEQ ID NOs provided below for specific genes, the discussion concerning gene knockouts is not limited in any way to the specific sequences provided herein. It is well known in the art that other DNAs which are substantially identical to the coding sequences described below can be useful (thus, e.g., slight sequence variation between different strains and hosts should be expected).

Gene Knockouts For Selection Of Transformants: As previously described in PCT Publication No. WO 2006/052870, it is possible to integrate plasmid DNA comprising expression cassettes into the orotidine-5'-phosphate decarboxylase gene locus (Ura3; GenBank Accession No. AJ306421 [SEQ ID NO:70]), the isopropyl malate dehydrogenase gene locus (Leu2; GenBank Accession No. AF260230 [SEQ ID NO:72]) and the saccharopine dehydrogenase gene locus (Lys5; GenBank Accession No. M34929 [SEQ ID NO:74]). This typically results in a gene knockout at the locus of integration, which can readily be utilized as a means to differentiate transformed versus non-transformed cells based on their ability to grow on media lacking uracil, leucine or lysine, respectively.

In some preferred methods, the Ura3 gene can be used repeatedly in combination with 5-fluoroorotic acid (5-fluorouracil-6-carboxylic acid monohydrate or "5-FOA") selection. 5-FOA is toxic to yeast cells that possess a functioning URA3 gene encoding orotidine 5'-monophosphate decarboxylase (OMP decarboxylase). Based on this toxicity, 5-FOA is especially useful for the selection and identification of Ura− mutant yeast strains (Bartel, P. L. and Fields, S., Yeast 2-Hybrid System, Oxford University: New York, v. 7, pp 109-147, 1997). More specifically, one can first knockout the native Ura3 gene to produce a strain having a Ura− phenotype, wherein selection occurs based on 5-FOA resistance. Then, a cluster of multiple chimeric genes and a new Ura3 gene could be integrated into a different locus of the *Yarrowia* genome to thereby produce a new strain having a Ura+ phenotype. Subsequent integration would produce a new Ura3− strain (again identified using 5-FOA selection), when the introduced Ura3 gene is knocked out. Thus, the Ura3 gene (in combination with 5-FOA selection) can be used as a selection marker in multiple rounds of transformation and thereby readily permit genetic modifications to be integrated into the *Yarrowia* genome in a facile manner.

Gene Knockouts To Diminish Fatty Acid And TAG Degradation: It is also useful to deliberately disrupt those pathways that affect fatty acid degradation and TAG degradation (e.g., when integrating various expression cassettes into the cell) in the optimized *Yarrowia lipolytica* described herein. This minimizes the degradation of accumulated EPA in either the acyl-CoA pool or in the TAG fraction of the cells (PCT Publication No. WO 2006/052870). These pathways are represented by the acyl-CoA oxidase and lipase genes, respectively. More specifically, the acyl-CoA oxidases (EC 1.3.3.6) catalyze a peroxisomal β-oxidation reaction wherein each cycle of degradation yields an acetyl-CoA molecule and a fatty acid that is two carbon atoms shorter than the fatty acid substrate. Five acyl-CoA oxidase isozymes are present in *Yarrowia lipolytica*, encoded by the POX1, POX2, POX3, POX4 and POX5 genes (also known as the Aco1, Aco2, Aco3, Aco4 and Aco5 genes), corresponding to GenBank Accession Nos. AJ001299-AJ001303, respectively (see also corresponding GenBank Accession Nos. XP_504703 [SEQ ID NO:75], XP_505264 [SEQ ID NO:76], XP_503244 [SEQ ID NO:77], XP_504475 [SEQ ID NO:78] and XP_502199 [SEQ ID NO:79]). Each of the isozymes has a different substrate specificity. For example, the POX3 gene encodes an acyl-CoA oxidase that is active against short-chain fatty acids, whereas the POX2 gene encodes an acyl-CoA oxidase that is active against longer-chain fatty acids (Wang H. J., et al., *J. Bacteriol.*, 181:5140-5148 (1999)). To avoid any confusion, the Applicants will refer to the acyl-CoA oxidases as described above as POX genes, although this terminology can be used interchangeably with the Aco gene nomenclature, according to some publicly available literature.

Similarly, several lipases (EC 3.1.1.3) have been detected in *Y. lipolytica*, including intracellular, membrane-bound and extracellular enzymes (Choupina, A., et al., *Curr. Genet.*, 35:297 (1999); Pignede, G., et al., *J. Bacteriol.*, 182:2802-2810 (2000)). For example, Lip1 (GenBank Accession No. Z50020 [SEQ ID NO:80]) and Lip3 (GenBank Accession No. AJ249751 [SEQ ID NO:84]) are intracellular or membrane bound, while Lip2 (GenBank Accession No. AJ012632 [SEQ ID NO:82]) encodes an extracellular lipase. Lip4a (GenBank Accession No. XP_503825 [SEQ ID NO:86]) is a *Yarrowia* lipase 4 (GenBank Accession No. XP_503697) homolog. It has high homology with an extracellular triacylglycerol lipase (GenBank Accession No. CAD21430) of *Candida deformans*. Each of these lipases are suitable targets for disruption, since the enzymes catalyze the reaction wherein TAG and water are degraded directly to DAG and a fatty acid anion.

Thus, as previously described in PCT Publication No. WO 2006/052870, it is advantageous to integrate plasmid DNA comprising expression cassettes into any of the following gene loci, thereby resulting in a gene knockout: Pox1 (Aco1), Pox2 (Aco2), Pox3 (Aco3), Pox4 (Aco4), Pox5 (Aco5), Lip 1, Lip2, Lip3 and Lip4a.

Other Gene Knockouts: Because of the relatively low frequency of homologous recombination in *Y. lipolytica*, integration of expression cassettes into the genome of *Y. lipolytica* can at times happen to unintendly disrupt *Y. lipolytica* genes other than those originally targeted. This provides an opportunity to screen for enhanced EPA production among transformants and identify additional useful gene knockouts. The following three knockouts were identified through these means, as well as the Pex10− knockout described infra.

*Y. lipolytica* SCP2 (YALI0E01298g [SEQ ID NO:87]) encodes a sterol carrier protein that participates in the transport and metabolism of lipids (Ferreyra R. G., et al., *Arch. Biochem. Biophys.*, 453:197-206 (2006)). It is suggested that the SCP2 protein localizes to the peroxisome and participates in the oxidation of long chain fatty acids by facilitating the interaction of the enzymes and the substrates. SCP2 has been shown to bind both fatty acids and their CoA esters. Thus, it may be beneficial to disrupt this gene, reducing the level of oxidation of EPA and other intermediates of the pathway. In the Examples herein, the SCP2− knockout was identified in strain Y4305.

ORF YALI0C18711g (GenBank Accession No. XP_501987 [SEQ ID NO:89]) was also found to tolerate gene disruption, upon insertion of an expression cassette within its translation start codon. YALI0C18711g is homologous to the *Saccharomyces cerevisiae* gene YLR050C, whose gene function is unknown. A chimeric protein consisting of GFP and YLR050C was shown to localize to the endoplasmic reticulum region (Huh W. K., et al., *Nature*, 425(6959):686-691 (2003)), suggesting a possible link to fatty acid desaturation or lipid production. In the Examples herein, the YALI0C18711g-knockout was first identified in strain Y4217.

Sometimes, integration of an expression cassette occurs outside of the coding region of a gene, but within the regulatory sequences preceding (5' non-coding sequences) and following (3' non-coding sequences) that particular coding sequence. This type of insertion can affect expression of the ORF. In the present Application, an expression cassette inserted into the 5'-region of YALI0F24167g (GenBank Accession No. XM_505819 [SEQ ID NO:91]) in strain Y4086, 154 bp upstream of the start codon. YALI0F24167g is homologous to the S. cerevisiae SPS4 gene, which appears to be expressed during sporulation (although the exact function is not clear) (Hepworth S R, et al., Mol. Cell. Biol., 15(7): 3934-3944 (1995)).

Diacylglycerol Acyltransferase Gene Knockouts: The intimate involvement of acyltransferases in the biosynthesis of TAGs, and the four eukaryotic acyltransferase gene families has been described in PCT Publication No. WO 2006/052870. These include the acyl-CoA:cholesterol acyltransferase ["ACAT"] family, commonly known as sterol acyltransferases; the lecithin:cholesterol acyltransferase ["LCAT"] family; the glycerol-3-phosphate acyltransferase and acyl-CoA lysophosphatidic acid acyltransferase ["GPAT/LPAAT"] family; and, the diacylglycerol acyltransferase ["DAG AT"] family. See also cited reviews by D. Sorger and G. Daum, Appl. Microbiol. Biotechnol., 61:289-299 (2003) and H. Mullner and G. Daum, Acta Biochimica Polonica, 51(2):323-347 (2004). The DAG AT family (EC 2.3.1.20), which includes DGAT2, is involved in the terminal step of TAG biosynthesis; specifically, the enzyme catalyzes addition of a third fatty acid to the sn-3 position of 1,2-diacylglycerol ["DAG"] to form TAG.

Knockouts of the native Yarrowia lipolytica genes encoding DGAT1 (characterized in PCT Publication No. WO 2006/052914), DGAT2 (SEQ ID NOs:93 and 94; characterized in U.S. Pat. No. 7,267,976) and PDAT (characterized in U.S. Pat. No. 7,267,976) were described in PCT Publication No. WO 2006/052870 (see Examples 29 and 30 therein). Specifically, it was found that total oil content was decreased and percent EPA was increased in strains comprising a disrupted DGAT2 and/or DGAT1 and/or PDAT gene. For example, a DGAT2 knockout resulted in doubling of the % EPA (of total fatty acids ["TFAs"]) and halving of the lipid content (as TFAs as % dry cell weight), as compared to the parental strain whose native DGAT2 was not disrupted. Further experimentation, as elaborated in PCT Publication No. WO 2006/052912, led to the hypothesis that one could regulate the activity of a host organism's native DAG ATs to thereby enable manipulation of the percent of PUFAs within the lipids and oils of the host. Specifically, since oil biosynthesis is expected to compete with polyunsaturation during oleaginy, it is possible to reduce or inactivate the activity of an organism's one or more acyltransferases (e.g., PDAT and/or DGAT1 and/or DGAT2), to thereby reduce the overall rate of oil biosynthesis while concomitantly increasing the percent of PUFAs (relative to the total fatty acids) that are incorporated into the lipid and oil fractions. This results since polyunsaturation is permitted to occur more efficiently; or, in other words, by down-regulating the activity of specific DAG ATs, the substrate competition between oil biosynthesis and polyunsaturation is reduced in favor of polyunsaturation during oleaginy.

Based on the data summarized above, it may be desirable for the recombinant Yarrowia production host to be devoid of its native gene encoding DGAT2 (SEQ ID NO:93).

Peroxisome Biogenesis Factor Protein (PEX) Gene Knockouts:

Peroxisomes are ubiquitous organelles found in all eukaryotic cells. Their primary role is the degradation of various substances within a localized organelle of the cell, such as toxic compounds, fatty acids, etc. For example, the process of β-oxidation, wherein fatty acid molecules are broken down to ultimately produce free molecules of acetyl-CoA (which are exported back to the cytosol), can occur in peroxisomes. Although the process of β-oxidation in mitochondria results in ATP synthesis, β-oxidation in peroxisomes causes the transfer of high-potential electrons to $O_2$ and results in the formation of $H_2O_2$, which is subsequently converted to water and $O_2$ by peroxisome catalases. Very long chain, such as $C_{18}$ to $C_{22}$, fatty acids undergo initial β-oxidation in peroxisomes, followed by mitochondrial β-oxidation.

The proteins responsible for importing proteins by means of ATP hydrolysis through the peroxisomal membrane are known as peroxisome biogenesis factor proteins, or "peroxins". These peroxisome biogenesis factor proteins also include those proteins involved in peroxisome biogenesis/assembly. The gene acronym for peroxisome biogenesis factor proteins is Pex; and, a system for nomenclature is described by Distel et al., J. Cell Biol., 135:1-3 (1996). At least 32 different Pex genes have been identified so far in various eukaryotic organisms. In fungi, however, the recent review of Kiel et al. (Traffic, 7:1291-1303 (2006)) suggests that the minimal requirement for peroxisome biogenesis/matrix protein import is numbered as 17, thereby requiring only Pex1p, Pex2p, Pex3p, Pex4p, Pex5p, Pex6p, Pex7p, Pex8p, Pex10p, Pex12p, Pex13p, Pex14p, Pex17p, Pex19p, Pex20p, Pex22p and Pex26p. These proteins act in a coordinated fashion to accomplish proliferation (duplication) of peroxisomes and protein import via translocation into peroxisomes (reviewed in Waterham, H. R. and J. M. Cregg. BioEssays, 19(1):57-66 (1996)).

Within the yeast Yarrowia lipolytica, a variety of different Pex genes have been identified based on homology and strong conservation of the peroxisome biogenesis machinery (Kiel et al., supra), including: YlPex1p (GenBank Accession No. CAG82178 [SEQ ID NO:95]), YlPex2p (GenBank Accession No. CAG77647 [SEQ ID NO:96]), YlPex3p (GenBank Accession No. CAG78565 [SEQ ID NO:97]), YlPex3 Bp (GenBank Accession No. CAG83356 [SEQ ID NO:98]), YlPex4p (GenBank Accession No. CAG79130 [SEQ ID NO:99]), YlPex5p (GenBank Accession No. CAG78803 [SEQ ID NO:100]), YlPex6p (GenBank Accession No. CAG82306 [SEQ ID NO:101]), YlPex7p (GenBank Accession No. CAG78389 [SEQ ID NO:102]), YlPex8p (GenBank Accession No. CAG80447 [SEQ ID NO:103]), YlPex10p (GenBank Accession No. CAG81606 [SEQ ID NO:104]), YlPex12p (GenBank Accession No. CAG81532 [SEQ ID NO:105]), YlPex13p (GenBank Accession No. CAG81789 [SEQ ID NO:106]), YlPex14p (GenBank Accession No. CAG79323 [SEQ ID NO:107]), YlPex16p (GenBank Accession No. CAG79622 [SEQ ID NO:108]), YlPex17p (GenBank Accession No. CAG84025 [SEQ ID NO:109]), YlPex19p (GenBank Accession No. AAK84827 [SEQ ID NO:110]), YlPex20p (GenBank Accession No. CAG79226 [SEQ ID NO:111]), YlPex22p (GenBank Accession No. CAG77876 [SEQ ID NO:112]) and YlPex26p (antisense translation of GenBank Accession No. NC_006072, nucleotides 117230-118387 [SEQ ID NO:113]). Furthermore, some of these genes have also been isolated and characterized. Bascom, R. A. et al. (Mol. Biol. Cell, 14:939-957 (2003)) describe YlPex3p; Szilard, R. K. et al. (J. Cell Biol., 131:1453-1469 (1995)) describe YlPex5p; Nuttley, W. M. et al. (*J. Biol. Chem.*, 269:556-566 (1994)) describe YlPex6p; Elizen G. A., et al. (*J. Biol. Chem.*, 270:1429-1436 (1995)) describe YlPex9p; Elizen G. A., et al. (*J. Cell Biol.*, 137:1265-1278 (1997)) and Titorenko, V. I. et al. (*Mol. Cell. Biol.*, 17:5210-5226 (1997)) describe YlPex16p; Lambkin, G. R. and R. A. Rachubinski (*Mol. Biol. Cell.*, 12(11):3353-3364 (2001)) describe YlPexl 9; and Titorenko V. I., et al. (*J. Cell Biol.*, 142:403-420 (1998)) and Smith J. J. and R. A. Rachubinski (*J. Cell Biol.*, 276:1618-1625 (2001)) describe YlPex20p. Of initial interest herein, however, was YlPex10p (GenBank Accession No. CAG81606, No. AB036770 and No. AJ012084). Characterized in Sumita et al. (*FEMS Microbiol. Lett.*, 214:31-38 (2002)), it was demonstrated that: 1) YlPex10p functions as a component of the peroxisome; and, 2) the $C_3HC_4$ zinc ring finger motif of YlPex10p was essential for the protein's function, determined via creation of C341S, C346S and H343W point mutations followed by analysis of growth.

It has been suggested that peroxisomes are required for both catabolic and anabolic lipid metabolism (Lin, Y. et al., *Plant Physiology*, 135:814-827 (2004)); however, this hypothesis was based on studies with a homolog of Pex16p. More specifically, Lin, Y. et al. (supra) reported that *Arabidopsis* Shrunken Seed 1 (sse1) mutants had both abnormal peroxisome biogenesis and fatty acid synthesis, based on a reduction of oil to approximately 10-16% of wild type in sse1 seeds. Relatedly, Binns, D. et al. (*J. Cell Biol.*, 173(5):719-731 (2006)) examined the peroxisome-lipid body interactions in *Saccharomyces cerevisiae* and determined that extensive physical contact between the two organelles promotes coupling of lipolysis within lipid bodies with peroxisomal fatty acid oxidation. More specifically, ratios of free fatty acids to TAGs were examined in various Pex knockouts and found to be increased relative to the wildtype. However, studies with Pex knockouts had not been previously conducted in PUFA-producing organisms prior to the work by the Applicants' Assignee.

In some preferred recombinant *Yarrowia* production hosts described herein, the host is devoid of a native gene encoding a peroxisome biogenesis factor protein selected from the group consisting of: Pex1p, Pex2p, Pex3p, Pex3 Bp Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21B, Pex22p, Pex22p-like and Pex26p. More preferred, the disrupted peroxisome biogenesis factor protein is Pex2p, Pex10p and/or Pex12p, as these three Pex proteins all possess a similar $C_3HC_4$ zinc ring finger motif near their C-terminus that is predicted to be required for their activity (FIG. 2A). Alternately, the disrupted peroxisome biogenesis factor protein is selected from the group consisting of Pex3p, Pex10p and Pex16p.

The disruption in the native gene encoding a peroxisome biogenesis factor protein can be an insertion, deletion, or targeted mutation within a portion of the gene, such as within the N-terminal portion of the protein or within the C-terminal portion of the protein. Alternatively, the disruption can result in a complete gene knockout such that the gene is eliminated from the host cell genome. Or, the disruption could be a targeted mutation that results in a non-functional protein. In any case, the disruption results in an increase in the amount of PUFAs, as a percent of total fatty acids, in the total lipid fraction and in the oil fraction of the recombinant *Yarrowia* production host, as compared with the parental strain whose native peroxisome biogenesis factor protein has not been disrupted.

As demonstrated in the Examples and as summarized in Table 5, infra, disruptions in either the C-terminal portion of the $C_3HC_4$ zinc ring finger motif of YlPex10p (Examples 4 and 5) or deletion of the entire chromosomal YlPex10 gene (Example 8) both resulted in an engineered EPA-producing strain of *Yarrowia lipolytica* that had an increased amount of PUFAs in the total lipid fraction and in the oil fraction, as a percent of total fatty acids, relative to the parental strain whose native Pex10p had not been disrupted. Furthermore, expression of an extrachromosomal YlPex10p in an engineered EPA-producing strain of *Yarrowia lipolytica* that possessed a disruption in the genomic Pex10p and an increased amount of PUFAs in the total lipid fraction and in the oil fraction reversed the effect (Example 6).

More specifically, Table 5 is a compilation of the data included within Examples 4, 5, 6 and 8, such that trends concerning total lipid content ["TFAs % DCW"], concentration of a given fatty acid(s) expressed as a weight percent of total fatty acids ["% TFAs"], and content of a given fatty acid(s) as its percent of the dry cell weight ["% DCW"] can be deduced, based on the presence or absence of a Pex10p disruption or knockout. "Desired PUFA % TFAs" and "Desired PUFA % DCW" quantify the particular concentration or content, respectively, of the desired PUFA product (i.e., EPA) which the engineered PUFA biosynthetic pathway was designed to produce. "All PUFAs" includes LA, ALA, EDA, DGLA, ETrA, ETA and EPA, while "C20 PUFAs" is limited to EDA, DGLA, ETrA, ETA and EPA.

TABLE 5

PUFA % TFAs and % DCW In *Yarrowia lipolytica* Strains With Mutant Pex Genes

| | | | | % TFAs | | | % DCW | | |
|---|---|---|---|---|---|---|---|---|---|
| Example | Strain | Genomic Pex Gene | TFA % DCW | Desired PUFA | All PUFAs | C20 PUFAs | Desired PUFA | All PUFAs | C20 PUFAs |
| 4, 5 | Y4086 | Wildtype Pex10 (SEQ ID NO: 104; 377 AA) | 28.6 | 9.8 | 60.1 | 25.2 | 2.8 | 17.2 | 7.2 |
| | Y4128 | Mutant* Pex10 (SEQ ID NO: 120; 345 AA) | 11.2 | 42.8 | 79.3 | 57.9 | 4.8 | 8.9 | 6.4 |
| 6 | Y4128 + pFBAIn-PEX10 | Mutant* Pex10 (SEQ ID NO: 120; 345 AA) + Plasmid Wildtype Pex10 (SEQ ID NO: 104; 377 AA) within chimeric FBAINm::Pex10::Pex20 gene | 29.2 | 10.8 | 60 | 27.3 | 3.1 | 17.5 | 8.0 |
| | Y4128 + pPEX10-1 | Mutant* Pex10 (SEQ ID NO: 120; 345 AA) + Plasmid | 27.1 | 10.7 | 60.1 | 26.7 | 2.9 | 16.2 | 7.2 |

TABLE 5-continued

PUFA % TFAs and % DCW In *Yarrowia lipolytica* Strains With Mutant Pex Genes

| | | | | % TFAs | | | % DCW | | |
|---|---|---|---|---|---|---|---|---|---|
| Example | Strain | Genomic Pex Gene | TFA % DCW | Desired PUFA | All PUFAs | C20 PUFAs | Desired PUFA | All PUFAs | C20 PUFAs |
| | Y4128 + pPEX10-2 | Wildtype Pex10 (SEQ ID NO: 104; 377 AA) within Pex10-5' (500 bp) ::Pex10::Pex10-3' gene Mutant* Pex10 (SEQ ID NO: 120; 345 AA) + Plasmid | 28.5 | 10.8 | 59 | 26.9 | 3.1 | 16.8 | 7.7 |
| | Y4128 + control | Wildtype Pex10 (SEQ ID NO: 104; 377 AA) within Pex10-5' (991 bp) ::Pex10::Pex10-3' gene Mutant* Pex10 (SEQ ID NO: 120; 345 AA) | 22.8 | 27.7 | 62.6 | 42.3 | 6.3 | 14.2 | 9.6 |
| 8 | Y4184U | Wildtype Pex10 (SEQ ID NO: 104; 377 AA) | 11.8 | 20.6 | nq♦ | nq♦ | 2.4 | nq♦ | nq♦ |
| | | | 8.8 | 23.2 | nq♦ | nq♦ | 2.0 | nq♦ | nq♦ |
| | Y4184U ΔPex10 | Mutant Pex10 | 17.6 | 43.2 | nq♦ | nq♦ | 7.6 | nq♦ | nq♦ |
| | | | 13.2 | 46.1 | nq♦ | nq♦ | 6.1 | nq♦ | nq♦ |

*Pex10 disruption in Y4128 results in a truncated protein, wherein the last 32 amino acids of the C-terminus (corresponding to the C-terminal portion of the $C_3HC_4$ zinc ring finger motif) are not present.
♦nq = not quantified The following conclusions can be drawn (relative to the parental strain whose native Pex protein had not been disrupted or the parental strain that was expressing a "replacement" copy of the disrupted native Pex protein):

1) Pex disruption in a PUFA-producing *Yarrowia* results in an increase in the weight percent of a single PUFA, for example EPA or DLGA, relative to the weight percent of total fatty acids (% TFAs) in the total lipid fraction and in the oil fraction;
2) Pex disruption in a PUFA-producing *Yarrowia* results in an increase in the weight percent of $C_{20}$ PUFAs relative to the weight percent of total fatty acids in the total lipid fraction and in the oil fraction;
3) By the extension of point 1), Pex disruption in a PUFA-producing *Yarrowia* results in an increase in the amount of any and all combinations of PUFAs relative to the weight percent of total fatty acids in the total lipid fraction and in the oil fraction; and
4) Pex disruption in a PUFA-producing *Yarrowia* results in an increase in the percent of a single PUFA, for example EPA or DLGA, relative to the dry cell weight.

Variable results are observed when comparing the effects of Pex disruptions in "All PUFAs % DCW", "C20 PUFAs % DCW" and TFA % DCW. Specifically, in some cases, the Pex disruption in the PUFA-producing *Yarrowia* results in an increased amount of $C_{20}$ PUFAs or All PUFAs, as a percent of dry cell weight, in the total lipid fraction and in the oil fraction (relative to the parental strain whose native Pex protein had not been disrupted). In other cases, there is a diminished amount of $C_{20}$ PUFAs or All PUFAs, as a percent of dry cell weight, in the total lipid fraction and in the oil fraction (relative to the parental strain whose native Pex protein had not been disrupted). Similar results are observed with respect to the total lipid content (TFA % DCW), in that the effect of the Pex disruption can either result in an increase in total lipid content or a decrease.

Based on peroxisome biogenesis factor proteins' ability to act with coordinated functionality within the cell, and without wishing to be held to any particular explanation or theory, it is hypothesized that disruption or knockout of a Pex gene within an oleaginous yeast cell affects both the catabolic and anabolic lipid metabolism that naturally occurs in peroxisomes or is affected by peroxisomes. Disruption or knockout results in an increase in the amount of PUFAs in the total lipid fraction and in the oil fraction, as a percent of total fatty acids, as compared with an oleaginous yeast whose native peroxisome biogenesis factor protein has not been disrupted. In some cases, an increase in the amount of PUFAs in the total lipid fraction and in the oil fraction as a percent of dry cell weight, and/or an increase in the total lipid content as a percent of dry cell weight, is also observed. It is hypothesized that this generalized mechanism is applicable within all eukaryotic organisms, such as algae, fungi, oomycetes, yeast, euglenoids, stramenopiles, plants and some mammalian systems, since all comprise peroxisomes.

Disruption Methodologies for Gene Knockouts

Although numerous techniques are available to one of skill in the art to achieve disruption of a native *Yarrowia* gene selected from the group consisting of Ura3, Lys5, Leu2, Pox1, Pox2, Pox3, Pox4, Pox5, Lip1, Lip2, Lip3, Lip4a, YALI0F24167g, YALI0C18711g, SCP2 [YALI0E01298g], DGAT2, Pex1p, Pex2p, Pex3p, Pex3 Bp Pex4p, Pex5p, Pex5 Bp, Pex5Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21B, Pex22p, Pex22p-like, Pex26p and Δ12 desaturase, generally the endogenous activity of a particular gene can be reduced or eliminated by the following techniques, for example: 1) disrupting the gene through insertion, substitution and/or deletion of all or part of the target gene; or, 2) manipulating the regulatory sequences controlling the expression of the protein. Both of these techniques will be discussed briefly below; however, one skilled in the art would appreciate that these are well described in the existing literature and are not limiting to the methods, host cells, and products described herein. One skilled in the art will also appreciate the most appropriate technique for use with any particular oleaginous yeast.

Disruption Via Insertion, Substitution And/Or Deletion: For gene disruption, a foreign DNA fragment (typically a selectable marker gene, but optionally a chimeric gene or chimeric gene cluster conveying a desirable phenotype upon expression) is inserted into the targeted gene in order to interrupt its coding region or promoter sequence and thereby functionally inactivate the gene. Transformation of the disruption cassette into the host cell results in replacement of the functional native gene by homologous recombination with the foreign DNA fragment (see, for example: Hamilton et al., *J. Bacteriol.*, 171:4617-4622 (1989); Balbas et al., *Gene*, 136:211-213 (1993); Gueldener et al., *Nucleic Acids Res.*, 24:2519-2524 (1996); and Smith et al., *Methods Mol. Cell. Biol.*, 5:270-277 (1996)). One skilled in the art will appreciate the many variations of the general method of gene targeting, which admit of positive or negative selection, creation of gene knockouts, and insertion of exogenous DNA sequences into specific genome sites in, for example, mammalian systems, plant cells, filamentous fungi and/or microbial systems. This methodology is preferred by the Applicants as a means to create gene disruptions in *Yarrowia lipolytica* (e.g., native genes encoding Leu– and Ura– were disrupted in various high EPA-producing recombinant strains in the Examples herein via the means described above).

However, as previously noted, *Y. lipolytica* exhibits a relatively low frequency of homologous recombination and thus expression cassettes often are inserted into the genome of *Y. lipolytica* at locations other than those originally targeted, despite the presence of targeting loci within the vector. This can result in disruption of random *Y. lipolytica* genes, as demonstrated herein by the disruption of native genes encoding YALI0C18711g, SCP2 and Pex10p, for example.

An alternate non-specific method of gene disruption is the use of transposable elements or transposons. Transposons are genetic elements that insert randomly into DNA but can be later retrieved on the basis of sequence to determine the locus of insertion. Both in vivo and in vitro transposition techniques are known and involve the use of a transposable element in combination with a transposase. When the transposable element or transposon is contacted with a nucleic acid fragment in the presence of the transposase, the transposable element will randomly insert into the nucleic acid fragment. The technique is useful for random mutagenesis and for gene isolation, since the disrupted gene may be identified on the basis of the sequence of the transposable element. Kits for in vitro transposition are commercially available and include: 1) The Primer Island Transposition Kit, available from Perkin Elmer Applied Biosystems, Branchburg, N.J., based upon the yeast Ty1 element; 2) The Genome Priming System, available from New England Biolabs, Beverly, Mass., based upon the bacterial transposon Tn7; and, 3) the EZ::TN Transposon Insertion Systems, available from Epicentre Technologies, Madison, Wis., based upon the Tn5 bacterial transposable element.

Manipulation Of Regulatory Sequences: The endogenous activity of a particular gene can also be reduced or eliminated by manipulating the regulatory sequences controlling expression of the protein. As is well known in the art, the regulatory sequences associated with a coding sequence include transcriptional and translational "control" nucleotide sequences located upstream (5' non-coding sequences), within, or downstream (3' non-coding sequences) of the coding sequence, and which influence the transcription, RNA processing or stability, or translation of the associated coding sequence. Thus, manipulation of a gene's regulatory sequences may refer to manipulation of the gene's promoters, silencers, 5' untranslated leader sequences (between the transcription start site and the translation initiation codon), introns, enhancers, initiation control regions, polyadenylation recognition sequences, RNA processing sites, effector binding sites and stem-loop structures of the particular gene. In all cases, however, the result of the manipulation is down-regulation of the gene's expression.

Thus, for example, the promoter of the *Yarrowia* ORF identified as YALI0F24167g was disrupted in some of the optimized high EPA-producing strains described herein. It will be obvious that similar manipulations could be performed within regulatory sequences corresponding to the *Yarrowia* genes encoding Ura3, Lys5, Leu2, Pox1, Pox2, Pox3, Pox4, Pox5, Lip1, Lip2, Lip3, Lip4a, YALI0C18711g, SCP2 [YALI0E01298g], DGAT2, Pex1p, Pex2p, Pex3p, Pex3 Bp Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21B, Pex22p, Pex22p-like, Pex26p and/or Δ12 desaturase to thereby result in gene down-regulation or knockout. Alternatively, the native promoter driving expression of one of the genes described above could be substituted with a heterologous promoter having diminished promoter activity with respect to the native promoter. Methods useful for manipulating regulatory sequences are well known to those skilled in the art.

The skilled person will be able to use these and other methods well known in the art to disrupt a native Ura3, Lys5, Leu2, Pox1, Pox2, Pox3, Pox4, Pox5, Lip1, Lip2, Lip3, Lip4a, YALI0F24167g, YALI0C18711g, SCP2 [YALI0E01298g], DGAT2, Pex1p, Pex2p, Pex3p, Pex3 Bp Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21B, Pex22p, Pex22p-like, Pex26p and/or Δ12 desaturase within the oleaginous yeast cell.

General Expression Systems, Cassettes, Vectors and Transformation for Expression of Foreign Genes Microbial expression systems and expression vectors containing regulatory sequences that direct high-level expression of foreign proteins are well known to those skilled in the art. Any of these could be used to construct chimeric genes encoding the preferred desaturases, elongases and CPT1 proteins. These chimeric genes could then be introduced into *Yarrowia lipolytica* using standard methods of transformation to provide high-level expression of the encoded enzymes.

Vectors (e.g., constructs, plasmids) and DNA expression cassettes useful for the transformation of *Yarrowia* host cells are well known in the art. The specific choice of sequences present in the construct is dependent upon the desired expression products, the nature of the host cell, and the proposed means of separating transformed cells versus non-transformed cells. Typically, however, the vector contains at least one expression cassette, a selectable marker and sequences allowing autonomous replication or chromosomal integration. Suitable expression cassettes typically comprise a region 5' of the gene that controls transcriptional initiation (e.g., a promoter), the gene coding sequence, and a region 3' of the DNA fragment that controls transcriptional termination (i.e., a terminator). It is most preferred when both control regions are derived from genes from the transformed host cell, although they need not be derived from genes native to the production host (e.g., *Yarrowia lipolytica*).

Where two or more genes are expressed from separate replicating vectors, it is desirable that each vector has a different means of selection and should lack homology to the other constructs to maintain stable expression and prevent reassortment of elements among constructs. Judicious choice of regulatory regions, selection means and method of propagation of the introduced construct can be experimentally determined so that all introduced genes are expressed at the necessary levels to provide for synthesis of the desired products.

Constructs or vectors comprising the gene(s) of interest may be introduced into a host cell such as *Yarrowia* by any standard technique. These techniques include transformation (e.g., lithium acetate transformation [*Methods in Enzymology*, 194:186-187 (1991)]), protoplast fusion, bolistic impact, electroporation, microinjection, or any other method that introduces the gene(s) of interest into the host cell. More preferred herein for *Yarrowia lipolytica* are integration techniques based on linearized fragments of DNA, as described in U.S. Pat. No. 4,880,741 and No. 5,071,764 and Chen, D. C. et al. (*Appl. Microbiol. Biotechnol.*, 48(2):232-235 (1997)).

For convenience, a host cell that has been manipulated by any method to take up a DNA sequence (e.g., an expression cassette) is referred to herein as "transformed", "transformant" or "recombinant". The transformed host will have at least one copy of the expression cassette and may have two or more, depending upon whether the expression cassette is integrated into the genome or is present on an extrachromosomal element having multiple copy numbers. The transformed host cell can be identified by various selection techniques, as described in U.S. Pat. No. 7,238,482 and U.S. Pat. No. 7,259,255.

Preferred selection methods for use herein are resistance to kanamycin, hygromycin and the amino glycoside G418, as well as ability to grow on media lacking uracil, leucine, lysine, tryptophan or histidine. In alternate embodiments, 5-fluoroorotic acid (5-fluorouracil-6-carboxylic acid monohydrate; "5-FOA") is used for selection of yeast Ura– mutants. The compound is toxic to yeast cells that possess a functioning URA3 gene encoding orotidine 5'-monophosphate decarboxylase (OMP decarboxylase) (Bartel, P. L. and Fields, S., Yeast 2-Hybrid System, Oxford University New York, v. 7, pp 109-147, 1997).

More specifically, one can first knockout the native Ura3 gene to produce a strain having a Ura– phenotype, wherein selection occurs based on 5-FOA resistance. Then, a cluster of multiple chimeric genes and a new Ura3 gene could be integrated into a different locus of the *Yarrowia* genome to thereby produce a new strain having a Ura+ phenotype. Subsequent integration would produce a new Ura3– strain (again identified using 5-FOA selection), when the introduced Ura3 gene is knocked out. Thus, the Ura3 gene, in combination with 5-FOA selection, can be used as a selection marker in multiple rounds of transformation and thereby readily permit genetic modifications to be integrated into the *Yarrowia* genome in a facile manner.

An alternate preferred selection method utilized herein relies on a dominant, non-antibiotic marker for *Yarrowia lipolytica* based on sulfonylurea resistance. More specifically, the marker gene is a native acetohydroxyacid synthase ("AHAS" or acetolactate synthase; E.C. 4.1.3.18) that has a single amino acid change, i.e., W497L, that confers sulfonyl urea herbicide resistance (SEQ ID NO:121; PCT Publication No. WO 2006/052870). AHAS is the first common enzyme in the pathway for the biosynthesis of branched-chain amino acids and it is the target of the sulfonylurea and imidazolinone herbicides.

An additional method utilized herein in *Yarrowia* for recycling a selection marker relies on site-specific recombinase systems. Briefly, the site-specific recombination system consists of two elements: 1) a recombination site having a characteristic DNA sequence [e.g., LoxP]; and, 2) a recombinase enzyme [e.g., Cre] that binds to the DNA sequence specifically and catalyzes recombination (i.e., excision) between DNA sequences when two or more of the recombination sites are oriented in the same direction at a given interval on the same DNA molecule. This methodology has utility as a means of selection, since it is possible to "recycle" a pair of preferred selection markers for their use in multiple sequential transformations.

More specifically, an integration construct is created comprising a target gene that is desirable to insert into the *Yarrowia* genome (e.g., a desaturase, elongase, CPT1), as well as a first selection marker (e.g., Ura3, hygromycin phosphotransferase [HPT]) that is flanked by recombination sites. Following transformation and selection of the transformants, the first selection marker is excised from the chromosome by the introduction of a replicating plasmid carrying a second selection marker (e.g., AHAS) and a recombinase suitable to recognize the site-specific recombination sites introduced into the genome. Upon selection of those transformants carrying the second marker and confirmation of excision of the first selection marker from the *Yarrowia* genome, the replicating plasmid is then cured from the host in the absence of selection. This produces a transformant that possesses neither the first nor second selection marker, and thus the cured strain is available for another round of transformation. One skilled in the art will recognize that the methodology is not limited to the particular selection markers or site-specific recombination system used herein.

Overexpression of Foreign Genes in *Yarrowia lipolytica*

As is well known to one of skill in the art, merely inserting a gene (e.g., a desaturase, elongase, CPT1) into a cloning vector does not ensure its expression at the desired rate, concentration, amount, etc. It may be desirable to manipulate a number of different genetic elements that control aspects of transcription, RNA stability, translation, protein stability and location, oxygen limitation and secretion from the host cell. More specifically, gene expression may be controlled by altering the following: the nature of the relevant transcriptional promoter and terminator sequences; the number of copies of the cloned gene; whether the gene is plasmid-borne or integrated into the genome of the host cell; the final cellular location of the synthesized foreign protein; the efficiency of translation in the host organism; the intrinsic stability of the cloned gene protein within the host cell; and, the codon usage within the cloned gene, such that its frequency approaches the frequency of preferred codon usage of the host cell. Several of these methods of overexpression will be discussed below, and are useful in recombinant *Yarrowia* host cells as a means to overexpress e.g., desaturases, elongases and CPT1 proteins.

Expression of the desired gene(s) can be increased at the transcriptional level through the use of a stronger promoter (either regulated or constitutive) to cause increased expression, by removing/deleting destabilizing sequences from either the mRNA or the encoded protein, or by adding stabilizing sequences to the mRNA (U.S. Pat. No. 4,910,141).

Initiation control regions or promoters which are useful to drive expression of heterologous genes or portions thereof in *Yarrowia* host cells are numerous and known to those skilled in the art. Expression can be accomplished in an induced or constitutive fashion. Induced expression can be accomplished by inducing the activity of a regulatable promoter operably linked to the gene of interest, while constitutive expression can be achieved by the use of a constitutive promoter operably linked to the gene of interest. Virtually any promoter (i.e., native, synthetic, or chimeric) capable of directing expression of desaturase, elongase and CPT1 genes in *Yarrowia* will be suitable, although transcriptional and translational regions from the host species are particularly useful. Despite the existence of a number of regulatory sequences that can be used for expression of genes in *Yarrowia* (e.g., depending upon whether constitutive or induced transcription is desired, the efficiency of the promoter in expressing the ORF of interest, the ease of construction and the like), in preferred embodiments the promoters are selected from those shown below in Table 6 (or derivatives thereof). A comparison of the activity of the below promoters is provided in PCT Publication No. WO 2006/052870.

TABLE 6

Promoters Preferred For Overexpression In *Yarrowia lipolytica*

| Promoter Name | Native Gene | Reference |
|---|---|---|
| GPD | glyceraldehyde-3-phosphate-dehydrogenase | U.S. Pat. No. 7,259,255 |
| GPDIN* | glyceraldehyde-3-phosphate-dehydrogenase | Patent Publication US 2006/0019297-A1 |
| GPM | phosphoglycerate mutase | U.S. Pat. No. 7,259,255 |
| GPM/FBAIN | phosphoglycerate mutase** | U.S. Pat. No. 7,202,356 |
| FBA | fructose-bisphosphate aldolase | U.S. Pat. No. 7,202,356 |
| FBAIN*** | fructose-bisphosphate aldolase | U.S. Pat. No. 7,202,356 |
| FBAINm**** | fructose-bisphosphate aldolase | U.S. Pat. No. 7,202,356 |
| GPAT | glycerol-3-phosphate O-acyltransferase | U.S. Pat. No. 7,264,949 |
| YAT1 | ammonium transporter enzyme | Patent Publication US 2006/0094102-A1 |
| EXP1 | export protein | PCT Publication No. WO 2006/052870 |

*The GPDIN promoter comprises a GPD promoter region, plus a portion of 5' coding region that has an intron of the gpd gene encoding glyceraldehyde-3-phosphate-dehydrogenase.
**The GPM/FBAIN promoter is a chimeric promoter comprising a fusion of the GPM promoter and the intron contained within the FBAIN promoter.
***The FBAIN promoter comprises a FBA promoter region, plus a portion of 5' coding region that has an intron of the fba1 gene encoding fructose-bisphosphate aldolase.
****The FBAINm promoter is a modified version of the FBAIN promoter, wherein FBAINm has a 52 bp deletion between the ATG translation initiation codon and the intron of the FBAIN promoter (thereby including only 22 amino acids of the N-terminus) and a new translation consensus motif after the intron. Additionally, while the FBAIN promoter generates a fusion protein when fused with the coding region of a gene to be expressed, the FBAINm promoter does not.

Of course, in alternate embodiments, other promoters which are derived from any of the promoter regions described in Table 6 can also be used for heterologous expression in *Yarrowia lipolytica* to facilitate high-level production and accumulation of EPA in the TAG and total lipid fractions. In particular, modification of the lengths of any of the promoters described above can result in a mutant promoter having identical or altered activity; however, the promoter will still be functional to drive gene expression in *Yarrowia*.

In general, the termination region can be derived from the 3' region of the gene from which the initiation region was obtained or from a different gene. A large number of termination regions are known and function satisfactorily in a variety of hosts when utilized both in the same and different genera and species from which they were derived. The termination region usually is selected more as a matter of convenience rather than because of any particular property. Preferably, the termination region is derived from a yeast gene, particularly *Saccharomyces*, *Schizosaccharomyces*, *Candida*, *Yarrowia* or *Kluyveromyces*. The 3'-regions of mammalian genes encoding γ-interferon and α-2 interferon are also known to function in yeast. The 3'-region can also be synthetic, as one of skill in the art can utilize available information to design and synthesize a 3'-region sequence that functions as a transcription terminator. A termination site may be unnecessary, but it is highly preferred.

Although not intended to be limiting, termination regions useful in the disclosure herein are derived from various genes native to *Yarrowia* and include: ~100 bp of the 3' region of the *Yarrowia lipolytica* extracellular protease (XPR; GenBank Accession No. M17741); the acyl-coA oxidase (Aco3: GenBank Accession No. AJ001301 and No. CAA04661; Pox3: GenBank Accession No. XP_503244) terminators; the Pex20 (GenBank Accession No. AF054613) terminator; the Pex16 (Gen Bank Accession No. U75433) terminator; the Lip1 (GenBank Accession No. Z50020) terminator; the Lip2 (GenBank Accession No. AJ012632) terminator; and the 3-oxoacyl-coA thiolase (OCT; GenBank Accession No. X69988) terminator.

Additional copies (i.e., more than one copy) of the PUFA biosynthetic pathway desaturase and elongase genes and/or CPT1 genes may be introduced into *Yarrowia lipolytica* to thereby increase EPA production and accumulation. Specifically, additional copies of genes may be cloned within a single expression construct; and/or, additional copies of the cloned gene(s) may be introduced into the host cell by increasing the plasmid copy number or by multiple integration of the cloned gene into the genome (infra). For example, in one embodiment, a strain of *Yarrowia lipolytica* (i.e., strain Y4128) was engineered to produce greater than 37.6% EPA, as a percent of total fatty acids, by the introduction and integration into the *Yarrowia* genome of chimeric genes comprising: 4 copies of Δ9 elongase, 4 copies of Δ8 desaturase, 3 copies of Δ5 desaturase, 3 copies of Δ17 desaturase, 3 copies of Δ12 desaturase and 1 copy of $C_{16/18}$ elongase.

Similarly, in an alternate embodiment, strain Y4305 of *Y. lipolytica* was engineered to produce greater than 53.2% EPA, as a percent of total fatty acids, by the introduction and integration into the *Yarrowia* genome of chimeric genes comprising: 7 copies of Δ9 elongase, 7 copies of Δ8 desaturase, 5 copies of Δ5 desaturase, 3 copies of Δ17 desaturase, 5 copies of Δ12 desaturase, 3 copies of $C_{16/18}$ elongase and 2 copies of diacylglycerol cholinephosphotransferase (CPT1).

It is important to note that the when preparing optimized strains of *Y. lipolytica* according to the methodology herein, copies of various desaturases, elongases, and CPT1s are often referred to. If, for example, 2 copies of a Δ9 elongase are required, this can refer to: 1) two copies of an identical coding sequence for a particular Δ9 elongase isolated from a single species; or, 2) one coding sequence for a Δ9 elongase isolated from a species "A" and one coding sequence for a Δ9 elongase isolated from a species "B", thus collectively resulting in two Δ9 elongases.

In general, once a DNA cassette (e.g., comprising a chimeric gene comprising a promoter, ORF and terminator) suitable for expression in an oleaginous yeast has been obtained, it is either placed in a plasmid vector capable of autonomous replication in a host cell or directly integrated into the genome of the host cell. Integration of expression cassettes can occur randomly within the host genome or can be targeted through the use of constructs containing regions of homology with the host genome sufficient to target recombination with the host locus. Although not relied on herein, all or some of the transcriptional and translational regulatory regions can be provided by the endogenous locus where constructs are targeted to an endogenous locus.

The preferred method of expressing genes in *Yarrowia lipolytica* is by integration of a linear DNA fragment into the genome of the host. Integration into multiple locations within the genome can be particularly useful when high level expression of genes are desired. Toward this end, it is desirable to identify a sequence within the genome that is present in multiple copies, such as Ylt1 and solo zeta elements, which are present in a dispersed manner throughout the genome of some strains of *Yarrowia lipolytica* in at least 35 copies/genome and 50-60 copies/genome (Schmid-Berger et al., *J. Bact.*, 176(9):2477-2482 (1994)). Unfortunately, however, not all strains of *Y. lipolytica* possess zeta regions (e.g., the strain identified as ATCC #20362). When the strain lacks such regions, it is also possible to integrate a linearized DNA fragment containing the expression cassette(s) into alternate loci to reach the desired copy number. For example, preferred alternate loci include: the Ura3 locus (GenBank Accession No. AJ306421), the Leu2 gene locus (GenBank Accession No. AF260230), the Lys5 gene locus (GenBank Accession No. M34929), the Aco2 gene locus (GenBank Accession No. AJ001300), the Pox3 gene locus (Pox3: GenBank Accession No. XP_503244; or, Aco3: GenBank Accession No. AJ001301), the Δ12 desaturase gene locus (U.S. Pat. No. 7,214,491), the Lip1 gene locus (GenBank Accession No. Z50020) and/or the Lip2 gene locus (GenBank Accession No. AJ012632). In alternate embodiments, the Pox1, Pox4, Pox5, Lip3, Lip4a, YALI0F24167g, YALI0C18711g, SCP2 [YALI0E01298g], DGAT2, Pex1p, Pex2p, Pex3p, Pex3 Bp Pex4p, Pex5p, Pex5 Bp, Pex5 Cp, Pex5/20p, Pex6p, Pex7p, Pex8p, Pex10p, Pex12p, Pex13p, Pex14p, Pex15p, Pex16p, Pex17p, Pex14/17p, Pex18p, Pex19p, Pex20p, Pex21p, Pex21B, Pex22p, Pex22p-like, Pex26p and Δ12 desaturase gene loci may be useful for integraton of constructs, as previously described.

Juretzek et al. (*Yeast*, 18:97-113 (2001)) note that the stability of an integrated DNA fragment in *Yarrowia lipolytica* is dependent on the individual transformants, the recipient strain and the targeting platform used. Thus, the skilled artisan will recognize that multiple transformants must be screened in order to obtain a strain displaying the desired expression level and pattern. Such screening may be accomplished by Southern analysis of DNA blots (Southern, *J. Mol. Biol.*, 98:503 (1975)), Northern analysis of mRNA expression (Kroczek, *J. Chromatogr. Biomed. Appl.*, 618 (1-2):133-145 (1993)), Western analysis of protein expression, phenotypic analysis or GC analysis of the PUFA products.

Fermentation Processes For EPA Production

The transformed microbial host cell is grown under conditions that optimize expression of chimeric genes (e.g., encoding desaturases, elongases, CPT1, etc.) and produce the greatest and the most economical yield of EPA. In general, media conditions may be optimized by modifying the type and amount of carbon source, the type and amount of nitrogen source, the carbon-to-nitrogen ratio, the amount of different mineral ions, the oxygen level, growth temperature, pH, length of the biomass production phase, length of the oil accumulation phase and the time and method of cell harvest. *Yarrowia lipolytica* are generally grown in a complex media such as yeast extract-peptone-dextrose broth (YPD) or a defined minimal media that lacks a component necessary for growth and thereby forces selection of the desired expression cassettes (e.g., Yeast Nitrogen Base (DIFCO Laboratories, Detroit, Mich.)).

Fermentation media for the methods and host cells described herein must contain a suitable carbon source, such as are taught in U.S. Pat. No. 7,238,482. Although it is contemplated that the source of carbon utilized in the present invention may encompass a wide variety of carbon-containing sources, preferred carbon sources are sugars, glycerol and/or fatty acids. Most preferred is glucose and/or fatty acids containing between 10-22 carbons.

Nitrogen may be supplied from an inorganic (e.g., $(NH_4)_2SO_4$) or organic (e.g., urea or glutamate) source. In addition to appropriate carbon and nitrogen sources, the fermentation media must also contain suitable minerals, salts, cofactors, buffers, vitamins and other components known to those skilled in the art suitable for the growth of the high EPA-producing oleaginous yeast and the promotion of the enzymatic pathways for EPA production. Particular attention is given to several metal ions, such as $Fe^{+2}$, $Cu^{+2}$, $Mn^{+2}$, $Co^{+2}$, $Zn^{+2}$ and $Mg^{+2}$, that promote synthesis of lipids and PUFAs (Nakahara, T. et al., *Ind. Appl. Single Cell Oils*, D. J. Kyle and R. Colin, eds. pp 61-97 (1992)).

Preferred growth media for the methods and host cells described herein are common commercially prepared media, such as Yeast Nitrogen Base (DIFCO Laboratories, Detroit, Mich.). Other defined or synthetic growth media may also be used and the appropriate medium for growth of *Yarrowia lipolytica* will be known by one skilled in the art of microbiology or fermentation science. A suitable pH range for the fermentation is typically between about pH 4.0 to pH 8.0, wherein pH 5.5 to pH 7.5 is preferred as the range for the initial growth conditions. The fermentation may be conducted under aerobic or anaerobic conditions, wherein microaerobic conditions are preferred.

Typically, accumulation of high levels of PUFAs in oleaginous yeast cells requires a two-stage process, since the metabolic state must be "balanced" between growth and synthesis/storage of fats. Thus, most preferably, a two-stage fermentation process is necessary for the production of EPA in *Yarrowia lipolytica*. This approach is described in U.S. Pat. No. 7,238,482, as are various suitable fermentation process designs (i.e., batch, fed-batch and continuous) and considerations during growth.

Purification and Processing of EPA

In some aspects herein, the primary product is oleaginous yeast biomass. As such, isolation and purification of the EPA-containing oils from the biomass may not be necessary (i.e., wherein the whole cell biomass is the product).

However, certain end uses and/or product forms may require partial and/or complete isolation/purification of the EPA-containing oil from the biomass, to result in partially purified biomass, purified oil, and/or purified EPA. PUFAs, including EPA, may be found in the host microorganism (e.g., *Yarrowia*) as free fatty acids or in esterified forms such as acylglycerols, phospholipids, sulfolipids or glycolipids. These fatty acids may be extracted from the host cell through a variety of means well-known in the art. One review of extraction techniques, quality analysis and acceptability standards for yeast lipids is that of Z. Jacobs (*Critical Reviews in Biotechnology*, 12(5/6):463-491 (1992)). A brief review of downstream processing is also available by A. Singh and O. Ward (*Adv. Appl. Microbiol.*, 45:271-312 (1997)).

In general, means for the purification of EPA and other PUFAs from *Yarrowia* biomass may include extraction (e.g., U.S. Pat. No. 6,797,303 and U.S. Pat. No. 5,648,564) with organic solvents, sonication, supercritical fluid extraction (e.g., using carbon dioxide), saponification and physical means such as presses, bead beaters, or combinations thereof. One is referred to the teachings of U.S. Pat. No. 7,238,482 for additional details.

Oils containing EPA that have been refined and/or purified can be hydrogenated, to thereby result in fats with various melting properties and textures. Many processed fats, including spreads, confectionary fats, hard butters, margarines, baking shortenings, etc., require varying degrees of solidity at room temperature and can only be produced through alteration of the source oil's physical properties. This is most commonly achieved through catalytic hydrogenation (see PCT Publication No. WO 2006/052870 for additional details and references).

Use of Compositions Comprising EPA

Food products, infant formulas, functional foods, medical foods, medical nutritionals, dietary supplements, pharmaceutical compositions, animal feeds, and personal care products comprising oleaginous yeast biomass comprising EPA are provided herein. Similarly, also provided are food products, infant formulas, dietary supplements, pharmaceutical compositions, animal feeds, and personal care products comprising EPA or microbial oil comprising EPA isolated from the recombinant oleaginous yeast biomass.

One of skill in the art of processing and formulation will understand how the amount and composition of the biomass, partially purified biomass, purified oil, and/or purified EPA may be added to a particular product according to target species and/or end use. More specifically, an "effective" amount should be incorporated into a product formulation, although this amount will depend on the food or feed product, the diet that the product is intended to supplement or the medical condition that the medical food or medical nutritional is intended to correct or treat. Most desirably, the effective amount of EPA will be sufficient to provide the desirable health characteristics associated with ω-3/ω-6 PUFA consumption. Typically, the amount of EPA incorporated into the product takes into account losses associated with processing conditions, typical handling and storage conditions, the stability of the EPA in the product, and the bioavailability/bioabsorption efficiency with the target species, to name a few.

One of skill in the art of processing and formulation will be familiar with processes to concentrate the oil produced from the recombinant Yarrowia production host cells described herein, to thereby increase the concentration of EPA in the total lipid fraction such that it comprises at least about 60%, at least about 70%, at least about 80% or even at least about 90% EPA. Means to blend the purified oils described herein with other purified fatty acids (e.g., LA, GLA, EDA, DGLA, ARA, DTA, DPAn-6, ALA, STA, ETrA, ETA, DPA and DHA), or oils containing alternate fatty acids in preferred concentrations, are also well known to one of skill in the art. These techniques readily permit the creation of an oil comprising a uniquely tailored fatty profile.

Personal Care Products: Within the context of personal care products, ω-3 fatty acids have particular application in skin formulations where they may be used to enhance the skin conditioning effect. The skilled person will understand how to provide an effective amount of the relevant ω-3 fatty acid(s) or oil comprising the same to a skin care composition. In addition to the PUFA oil or ω-3 fatty acid, the skin care composition may further comprise a cosmetically acceptable medium for skin care compositions, examples of which are described by Philippe et al. in U.S. Pat. No. 6,280,747. For example, the cosmetically acceptable medium may be an anhydrous composition containing a fatty substance in a proportion generally from about 10% to about 90% by weight relative to the total weight of the composition, where the fatty phase contains at least one liquid, solid or semi-solid fatty substance. The fatty substance includes, but is not limited to, oils, waxes, gums, and so-called pasty fatty substances. Alternatively, the compositions may be in the form of a stable dispersion such as a water-in-oil or oil-in-water emulsion. Additionally, the compositions may contain one or more conventional cosmetic or dermatological additives or adjuvants including, but not limited to, antioxidants, preserving agents, fillers, surfactants, UVA and/or UVB sunscreens, fragrances, thickeners, wetting agents and anionic, nonionic or amphoteric polymers, and dyes.

Foodstuffs: The market place currently supports a large variety of food and feed products, incorporating ω-3 and/or ω-6 fatty acids (particularly LA, GLA, ARA, EPA, DPA and DHA). It is contemplated that the yeast biomass, partially purified biomass, purified oil, and/or purified EPA described herein will function in food products to impart the health benefits of current formulations.

Yarrowia biomass, partially purified biomass, purified oil, and/or purified EPA produced by the yeast hosts described herein will be suitable for use in a variety of food products including, but not limited to: food analogs, drinks, meat products, cereal products, baked foods, snack foods and a dairy products.

Food analogs can be made using processes well known to those skilled in the art. There can be mentioned meat analogs, cheese analogs, milk analogs and the like. Meat analogs made from soybeans contain soy protein or tofu and other ingredients mixed together to simulate various kinds of meats. These meat alternatives are sold as frozen, canned or dried foods. Usually, they can be used the same way as the foods they replace. Examples of meat analogs include, but are not limited to: ham analogs, sausage analogs, bacon analogs, and the like.

Food analogs can be classified as imitation or substitutes depending on their functional and compositional characteristics. For example, an imitation cheese need only resemble the cheese it is designed to replace. However, a product can generally be called a substitute cheese only if it is nutritionally equivalent to the cheese it is replacing and meets the minimum compositional requirements for that cheese. Thus, substitute cheese will often have higher protein levels than imitation cheeses and be fortified with vitamins and minerals.

Milk analogs or nondairy food products include, but are not limited to: imitation milks and nondairy frozen desserts (e.g., those made from soybeans and/or soy protein products).

Meat products encompass a broad variety of products. In the United States "meat" includes "red meats" produced from cattle, hogs and sheep. In addition to the red meats there are poultry items which include chickens, turkeys, geese, guineas, ducks and the fish and shellfish. There is a wide assortment of seasoned and processed meat products: fresh, cured and fried, and cured and cooked. Sausages and hot dogs are examples of processed meat products. Thus, the term "meat products" as used herein includes, but is not limited to, processed meat products.

A cereal food product is a food product derived from the processing of a cereal grain. A cereal grain includes any plant from the grass family that yields an edible grain (seed). The most popular grains are barley, corn, millet, oats, quinoa, rice, rye, sorghum, triticale, wheat and wild rice. Examples of a cereal food products include, but are not limited to: whole grain, crushed grain, grits, flour, bran, germ, breakfast cereals, extruded foods, pastas, and the like.

A baked goods product comprises any of the cereal food products mentioned above and has been baked or processed in a manner comparable to baking, i.e., to dry or harden by subjecting to heat. Examples of a baked good product include, but are not limited to: bread, cakes, doughnuts, bars, pastas, bread crumbs, baked snacks, mini-biscuits, mini-crackers, mini-cookies, and mini-pretzels. As was mentioned above, oils from the recombinant EPA production host cells can be used as an ingredient.

A snack food product comprises any of the above or below described food products.

A fried food product comprises any of the above or below described food products that has been fried.

The beverage can be in a liquid or in a dry powdered form. For example, there can be mentioned: non-carbonated drinks; fruit juices, fresh, frozen, canned or concentrate; flavored or plain milk drinks, etc. Adult and infant nutritional formulas are well known in the art and commercially available (e.g., Similac®, Ensure®, Jevity®, and Alimentum® from Ross Products Division, Abbott Laboratories).

A dairy product is a product derived from milk. A milk analog or nondairy product is derived from a source other than milk, for example, soymilk as was discussed above. These products include, but are not limited to: whole milk, skim milk, fermented milk products such as yoghurt or sour milk, cream, butter, condensed milk, dehydrated milk, coffee whitener, coffee creamer, ice cream, cheese, etc.

Additional food products into which the *Yarrowia* biomass, partially purified biomass, purified oil, and/or purified EPA could be included are, for example: chewing gums, confections and frostings, gelatins and puddings, hard and soft candies, jams and jellies, white granulated sugar, sugar substitutes, sweet sauces, toppings and syrups, and dry-blended powder mixes.

Infant Formulas: Infant formulas are liquids or reconstituted powders fed to infants and young children. "Infant formula" is defined herein as an enteral nutritional product which can be substituted for human breast milk in feeding infants and typically is composed of a desired percentage of fat mixed with desired percentages of carbohydrates and proteins in an aquous solution (e.g., see U.S. Pat. No. 4,670,285). Based on worldwide composition studies, as well as levels specified by expert groups, average human breast milk typically contains about 0.20% to 0.40% of total fatty acids (assuming about 50% of calories from fat); and, generally the ratio of DHA to ARA would range from about 1:1 to 1:2 (see, e.g., formulations of Enfamil LIPIL™ [Mead Johnson & Company] and Similac Advance™ [Ross Products Division, Abbott Laboratories]). Infant formulas have a special role to play in the diets of infants because they are often the only source of nutrients for infants. Although breast-feeding is still the best nourishment for infants, infant formula is a close enough second that babies not only survive but thrive.

Health Food Products And Pharmaceuticals: The present biomass, partially purified biomass, purified oil, and/or purified EPA may be used in formulations to impart health benefit in health food products, including functional foods, medical foods, medical nutritionals and dietary supplements. Additionally, *Yarrowia* biomass, partially purified biomass, purified oil, and/or purified EPA of the invention may be used in standard pharmaceutical compositions. The present engineered strains of *Yarrowia lipolytica* or the microbial oils produced therefrom comprising EPA could readily be incorporated into the any of the above mentioned food products, to thereby produce e.g., a functional or medical food. For example, more concentrated formulations comprising EPA include capsules, powders, tablets, softgels, gelcaps, liquid concentrates and emulsions which can be used as a dietary supplement in humans or animals other than humans.

Animal Feed Products: Animal feeds are generically defined herein as products intended for use as feed or for mixing in feed for animals other than humans. The *Yarrowia* biomass, partially purified biomass, purified oil, and/or purified EPA described herein can be used as an ingredient in various animal feeds.

More specifically, although not to be construed as limiting, it is expected that the EPA products from the recombinant *Yarrowia* host cells can be used within pet food products, ruminant and poultry food products and aquacultural food products. Pet food products are those products intended to be fed to a pet, such as a dog, cat, bird, reptile, rodent. These products can include the cereal and health food products above, as well as meat and meat byproducts, soy protein products, grass and hay products, such as alfalfa, timothy, oat or brome grass, vegetables. Ruminant and poultry food products are those wherein the product is intended to be fed to e.g., turkeys, chickens, cattle and swine. As with the pet foods above, these products can include cereal and health food products, soy protein products, meat and meat byproducts, and grass and hay products as listed above. Aquacultural food products (or "aquafeeds") are those products intended to be used in aquafarming which concerns the propagation, cultivation or farming of aquatic organisms and/or animals in fresh or marine waters.

It is contemplated that the present engineered strains of *Yarrowia lipolytica* that are producing high concentrations of EPA will be especially useful to include in most animal feed formulations. In addition to providing necessary ω-3 PUFAs, the yeast itself is a useful source of protein and other nutrients (e.g., vitamins, minerals, nucleic acids, complex carbohydrates, etc.) that can contribute to overall animal health and nutrition, as well as increase a formulation's palatablility. Accordingly it is contemplated that the addition of yeast biomass comprising the recombinant *Yarrowia* production hosts will be an excellent additional source of feed nutrients in animal feed formulations. More specifically, *Yarrowia lipolytica* (ATCC #20362) has the following approximate chemical composition, as a percent relative to the dry cell weight: 35% protein, 40% lipid, 10% carbohydrate, 5% nucleic acids, 5% ash and 5% moisture. Furthermore, within the carbohydrate fraction, β-glucans comprise approximately 45.6 mg/g, mannans comprise approximately 11.4 mg/g, and chitin comprises approximately 52.6 mg/g (while trehalose is a minor component [approximately 0.7 mg/g]).

A considerable body of literature has examined the immuno-modulating effects of β-glucans, mannans and chitin (reviewed in PCT Publication No. WO 2006/052870). Based on the unique protein:lipid:carbohydrate composition of *Yarrowia lipolytica*, as well as unique complex carbohydrate profile (comprising an approximate 1:4:4.6 ratio of mannan:β-glucans:chitin), it is contempated that the genetically engineered yeast cells described herein (or portions thereof) would be a useful additive to animal feed formulations. Thous could occur, for example, by addition of whole [lyophilized] yeast cells, purified cells walls, purified yeast carbohydrates or by addition of various other fractionated forms.

With respect to the aquaculture industry, an increased understanding of the nutritional requirements for various fish species and technological advances in feed manufacturing have allowed the development and use of manufactured or artificial diets (formulated feeds) to supplement or to replace natural feeds. In general, however, the general proportions of various nutrients included in aquaculture feeds for fish include (with respect to the percent by dry diet): 32-45% proteins, 4-28% fat (of which at least 1-2% are ω-3 and/or ω-6 PUFAs), 10-30% carbohydrates, 1.0-2.5% minerals and 1.0-2.5% vitamins. A variety of other ingredients may optionally be added to the formulation. These include: 1) carotenoids, particularly for salmonid and ornamental "aquarium" fishes, to enhance flesh and skin coloration, respectively; 2) binding agents, to provide stability to the pellet and reduce leaching of nutrients into the water (e.g., beef heart, starch, cellulose, pectin, gelatin, gum arabic, locust bean, agar, carageenin and other alginates); 3) preservatives, such as antimicrobials and antioxidants, to extend the shelf-life of fish diets and reduce the rancidity of the fats (e.g., vitamin E, butylated hydroxyanisole, butylated hydroxytoluene, ethoxyquin, and sodium and potassium salts of propionic, benzoic or sorbic acids); 4) chemoattractants and flavorings, to enhance feed palatability and its intake; and, 5) other feedstuffs. These other feedstuffs can include such materials as fiber and ash, for use as a filler and as a source of calcium and phosphorus, respectively, and vegetable matter and/or fish or squid meal (e.g., live, frozen or dried algae, brine shrimp, rotifers or other zooplankton) to enhance the nutritional value of the diet and increase its acceptance by the fish. *Nutrient Requirements of Fish* (National Research Council, National Academy: Washington D.C., 1993) provides detailed descriptions of the essential nutrients for fish and the nutrient content of various ingredients.

The manufacture of aquafeed formulations requires consideration of a variety of factors, since a complete diet must be nutritionally balanced, palatable, water stable, and have the proper size and texture. With regard to nutrient composition of aquafeeds, one is referred to: *Handbook on Ingredients for Aquaculture Feeds* (Hertrampf, J. W. and F. Piedad-Pascual. Kluwer Academic: Dordrecht, The Netherlands, 2000) and *Standard Methods for the Nutrition and Feeding of Farmed Fish and Shrimp* (Tacon, A. G. J. Argent Laboratories: Redmond, 1990). In general, feeds are formulated to be dry (i.e., final moisture content of 6-10%), semi-moist (i.e., 35-40% water content) or wet (i.e., 50-70% water content). Dry feeds include the following: simple loose mixtures of dry ingredients (i.e., "mash" or "meals"); compressed pellets, crumbles or granules; and flakes. Depending on the feeding requirements of the fish, pellets can be made to sink or float. Semi-moist and wet feeds are made from single or mixed ingredients, such as trash fish or cooked legumes, and can be shaped into cakes or balls.

It is clear then that the present engineered strains of *Yarrowia lipolytica* that are producing high concentrations of EPA will be especially useful to include in most aquaculture feeds. In addition to providing necessary ω-3 and/or ω-6 PUFAs, the yeast itself is a useful source of protein that can increase the formulation's palatablility. In alternate embodiments, the oils produced by the present strains of *Y. lipolytica* could be introduced directly into the aquaculture feed formulations, following extraction and purification from the cell mass.

Clinical Health Benefits Resulting from EPA Supplementation

Although dietary supplementation of EPA has been shown to be useful to lower serum cholesterol and triglycerides and have salutary effects in e.g., coronary heart disease, high blood pressure, inflammatory disorders (e.g., rheumatoid arthritis), lung and kidney diseases, Type II diabetes, obesity, ulcerative colitis, Crohn's disease, anorexia nervosa, burns, osteoarthritis, osteoporosis, attention deficit/hyperactivity disorder, early stages of colorectal cancer and mental disorders (e.g., schizophrenia) (see, for example, the review of McColl, J., *NutraCos*, 2(4):35-40 (2003); Sinclair, A., et al. In *Healthful Lipids*; C. C. Akoh and O.-M. Lai, Eds; AOCS: Champaign, Ill. (2005), Chapter 16), the molecular and biochemical mechanisms underlying these clinical observations remain to be elucidated. Notably, many past studies have failed to recognize that individual long-chain ω-3 fatty acids (e.g., EPA and DHA) are metabolically and functionally distinct from one another, and thus each may have a specific physiological function. This lack of mechanistic clarity is largely a consequence of the use of fish oils as a source of the PUFAs, as opposed to use of pure EPA or pure DHA in clinical studies [the fatty acid composition of oils from menhaden, cod liver, sardines and anchovies, for example, comprise oils having a ratio of EPA:DHA of approximately 0.9:1 to 1.6:1 (based on data within *The Lipid Handbook*, $2^{nd}$ ed.; F. D. Gunstone, J. L. Harwood and F. B. Padley, Eds; Chapman and Hall, 1994)]. Nonetheless, there is increasing awareness that EPA is an important ω-3 fatty acid in and of itself. As a result, it is expected herein that the EPA-enriched oils of the recombinant *Yarrowia* production hosts described herein will have very broad utility in a variety of therapeutic applications, e.g., inflammation, cardiovascular diseases, nutrient regulation of gene expression and dyslipidemia, and specifically in the treatment of clinical conditions including: coronary heart disease, high blood pressure, inflammatory disorders, Type II diabetes, ulcerative colitis, Crohn's disease, anorexia nervosa, burns, osteoarthritis, osteoporosis, and attention deficit/hyperactivity disorder.

Although the results described below in relation to each of these applications are based on clinical human studies, this should not be construed as limiting; specifically, the Applicants foresee use of EPA-enriched oils for treatment of similar health concerns in a variety of other animals (e.g., household pets, ruminant animals, poultry, fish, etc.).

EPA And Inflammation: Many biochemical mechanisms have been proposed to explain the anti-inflammatory properties conveyed by fish oils. Currently, a popular mechanism suggests that ω-3 fatty acids decrease the amount of ω-6 fatty acids in inflammatory cell membranes and inhibit ω-6 fatty acid metabolism that enables synthesis of pro-inflammatory mediators derived from ω-6 fatty acids (e.g., series 2 prostaglandins and series 4 leukotrienes). Additionally, the ω-3 fatty acids give rise to potent inflammatory mediators (e.g., series 3 prostaglandins and series 5 leukotrienes). However, recent studies have now identified a new family of lipid anti-inflammatory mediators, termed resolvins ("resolution phase interaction products"), which are very potent as indicated by their biological activity in the low nanomolar range. Within this family are both EPA-derived resolvins (i.e., E-series resolvins or "RvEs") and DHA-derived resolvins (i.e., D-series resolvins or "RvDs") (reviewed in Serhan, C. N., *Pharma. & Therapeutics*, 105:7-21 (2005)). The distinct role of RvE1 (5S,12R,18R-trihydroxy-6Z,8E,10E,14Z,16E-EPA), as demonstrated in Arita, M. et al. (*Proc. Natl. Acad. Sci. U.S.A.*, 102(21):7671-7676 (2005)) offers mechanistic evidence that may form the basis for some of the beneficial actions of EPA in human health and disease.

This new biology underscores the potential utility of EPA-rich products in both the nutritional and medical management of inflammatory processes. Furthermore, since inflammation underlies many diseases ranging from cardiovascular to metabolic (e.g., metabolic syndrome X, obesity, diabetes) to neurological diseases (e.g., Alzheimers), it is expected that EPA-enriched oils (such as those described herein) will have very broad utility. It is expected that medical utility may be derived from: 1) use of EPA or RvEs as bioactives in medical foods; and/or, 2) addition of EPA to over-the-counter or prescriptive medications as adjunctive therapy. Finally, EPA may find utility as a precursor for the synthesis of RvEs and medicinally-optimized new chemical entities.

EPA And Cardiovascular Diseases: Fish oil and its related ω-3 fatty acids have shown considerable cardioprotection in the management of cardiovascular disease in secondary prevention (i.e., a setting wherein subjects already presented with cardiovascular symptoms or who had suffered a cardiovascular event). As promising as these studies are, however, they leave a number of key questions unanswered; notably, the relative importance of EPA versus DHA and the efficacy of these fatty acids in a primary prevention setting [e.g., in patients with: 1) no history of myocardial infarction or angina pectoris and with neither angioplasty/stenting nor coronary artery bypass grafts; and, 2) no clinical manifestations of angina pectoris or electrocardiograph abnormalities].

The Japanese EPA Lipid Intervention Study ("JELIS") endeavored to address these questions in a large-scale randomized controlled trial using >98% purified EPA-ethyl esters in combination with a statin (Yokoyama, M. and H.

Origasa, *Amer. Heart J.*, 146:613-620 (2003); Yokoyama, M. et al., *Lancet*, 369:1090-1098 (2007)). As predicted, the authors discovered that cardiovascular events in patients receiving EPA plus statin decreased by 19% with respect to those patients receiving statin alone. This provides strong support that EPA, per se, is cardioprotective, and thereby should help open the market for EPA-enriched oils. It may also afford opportunities to combine EPA/resolvin type mixtures with statins, and/or for the oils derived from recombinant *Yarrowia* described herein to be utilized as a high purity source of EPA in the production of EPA-ethyl ester drugs that are presently sourced and manufactured from fish oil (e.g., EPADEL from Mochida Pharmaceutical Co., Ltd., Tokyo, Japan).

It has long been established that C-reactive protein (CRP) is a useful biomarker in tracking various inflammatory and metabolic conditions such as cardiometabolic diseases (e.g., metabolic syndrome, non-alcoholic steatohepatitis, non-alcoholic fatty liver disease, pre-diabetic conditions such as "insulin resistance", diabetes), neurobehavioral conditions (e.g., alzheimer disease, attention deficit/hyperactivity disorders, depression, biopolar disorders, schizophrenia, post partum depression, post menopausal disorders, e.g., hot flashes), inflammatory disorders e.g., colitis, Crohn's, irritable bowel disease and resolvin-related disorders where elevated serum concentrations of CRP are associated with increased risk of disease (*N. Engl. J. Med.*, 343(7):512 (2000); *Diabetes Care*, 28:878-881 (2005); *Digestive and Liver Disease*, 40(3):194-199 (2008); *Applied Physiology, Nutrition, and Metabolism*, 32(6): 1008-1024 (2007); *American Journal of Physiology*, 294(1, Pt. 1): G27-G38 (2008); *Progress in Nutrition*, 9(2): 124-133 (2007); *Nutrients, Stress, and Medical Disorders*, 317-324 (2006). Editor(s): Yehuda, Shlomo; Mostofsky, David I. Publisher: Humania Press Inc., Totowa, N.J.). Methods for testing serum concentrations of C-reactive protein are advanced and well characterized. A number of studies have concluded that the administration of ω-3 fatty acids can be correlated to reduced serum levels of C-reactive protein (*Nutrition Research* (New York, N.Y., United States), 28(5):309-314 (2008); *Journal of Biological Sciences* (Faisalabad, Pakistan), 7(8):1368-1374 (2007); *Nephrology, Dialysis, Transplantation*, 22(12):3561-3567 (2007)). Accordingly, it is within the scope of the present invention to provide methods for the treatment of clinical conditions such as those mentioned above as well as methods for the reduction of serum levels of C-reactive proteins via the administration of the recombinant microbial oils described herein in a consumable form wherein the clinical condition is treated or the levels of C-reactive protein are reduced.

Omega-3 PUFAs And Nutrient Regulation Of Gene Expression: It is well known that long-chain ω-3 PUFAs function as fuel partitioners capable of directing: 1) glucose away from fatty acid biosynthesis and toward glycogen storage; and, 2) fatty acids away from triglyceride synthesis and toward oxidation. The net effect of this re-partitioning is a decrease in circulating triglycerides and, in some species, a decrease in fat deposition. There is increasing scientific evidence that the molecular mechanisms by which these long-chain ω-3 PUFAs exert their effects on metabolism is the result of interactions with various ligand-activated transcription factors which in turn regulate gene expression.

To date, the regulation of gene transcription by fatty acids seems to be due to changes in the activity or abundance of at least 4 transcription factor families: PPAR (peroxisome proliferator-activated receptor), LXR (liver x receptor), HNF-4α (hepatic nuclear factor 4) and SREBP (sterol regulatory element binding protein) (see, Clarke, S. D., *J Nutr.*, 131(4): 1129-1132 (2001) and *Curr. Opin. Lipidology*, 15:13-18 (2004); Pégorier, J.-P. et al., *J Nutr.*, 134:2444 S-2449S (2004)). As an example of this interaction, it is believed that EPA lowers serum triglycerides via activation of PPARα in the liver; and, some of its anti-inflammatory activity (particularly at the level of the vessel wall) may also be mediated by PPAR biology in arterial macrophages.

Knowledge of the mechanisms by which fatty acids control specific gene expression may provide insight into the development of new therapeutic strategies for better management of whole body lipid metabolism and the control of serum levels of triglycerides and cholesterol, established risk factors for coronary heart diseases and other chronic diseases. Likewise, it is expected that future studies will appreciate the differential roles EPA versus DHA play as regulators of nutrient-gene interactions in the maintaining and promoting of optimal human health.

Omega-3 PUFAs And Dyslipidemia: Intake of fish oil has often been associated with a slight increase in low-density lipoprotein (LDL) cholesterol, an untoward event that conveys an increased risk of heart disease. The recent study of Theobald, H. E. et al. (*Amer. J. Clinical Nutrition*, 79:558-563 (2004)) suggests that this elevation in LDL cholesterol may actually be due to DHA (as opposed to EPA). Specifically, daily intake of ~0.7 g DHA increased LDL cholesterol by 7% in middle-aged men and women over a 3 month period; in contrast, studies using purified EPA or EPA-rich oil have generally not reported similar increases in LDL cholesterol (Harris, W. S., *Amer. J. Clinical Nutrition*, 65(Supplement): 1645S-1654S (1997)). Although further studies are necessary to clarify the reasons for the increase in LDL cholesterol resulting from low dosages of DHA, the utility of the EPA-rich oils of the present invention that do not contain DHA potentially may have significant clinical advantages.

Although it may be desirable to purify the recombinant microbial oils described herein to result in an oil that comprises relatively pure EPA, in alternate embodiments there may be advantages observed by use of a final oil product that is enriched in EPA and at least one other PUFA. For example, evidence indicates that supplementation with a combination of EPA and GLA may have a favorable impact on serum lipids. Specifically, as reported by M. Laidlaw and B. J. Holub (*Amer. J. Clinical Nutrition*, 77:37-42 (2003)), a daily supplement comprising a mixture of EPA and DHA (4 g total) and GLA (2 g) favorably altered blood lipid and fatty acid profiles in healthy women over the course of 28 days. In addition to decreasing the LDL cholesterol of patients by 11.3%, the calculated 10-year risk of myocardial infarction was reduced by 43% in those patients receiving EPA, DHA and GLA. Thus, the addition of GLA offset the tendency of EPA and DHA to cause a slight elevation of LDL cholesterol (Theobald et al., supra). Taken together, the studies by Laidlaw and Holub and Theobald et al. may suggest clinical benefit in an oil enriched with both EPA and GLA, but not DHA.

The utility of a GLA and EPA supplement combination has also been widely popularized as a means to reduce and combat chronic inflammation as it relates to diseases such as arthritis, diabetes and heart disease (F. Chilton and L. Tucker, *Inflammation Nation: The First Clinically Proven Eating Plan to End Our Nation's Secret Epidemic*. Fireside Books). Specifically, although GLA supplementation was previously shown to reduce the generation of lipid mediators of inflammation and attenuate clinical symptoms of chronic inflammatory disorders (e.g., rheumatoid arthritis), supplementation with this same fatty acid also was known to cause a marked increase in serum ARA levels, a potentially harmful side effect. The rationale for these dichotomous effects was credited to the presence of Δ5 desaturase activity in the liver, which enabled complete conversion of the essential ω-6 fatty acid LA to ARA (via the ω-6 Δ6 desaturase/Δ6 elongase pathway and through GLA and DGLA intermediates), while inflammatory cells such as neutrophils lacked the metabolic capacity to convert DGLA to ARA. It was therefore hypothesized that co-supplementation with EPA would block the synthesis of ARA in the liver, while enabling synthesis of DGLA. Clinical proof of principle was established in human feeding studies by J. B. Barham et al. (*J. Nutr.*, 130:1925-1931 (2000)), wherein a supplementation strategy that maintained the capacity of GLA to reduce lipid mediators (without causing elevations in serum ARA level) was demonstrated to require addition of EPA. Thus, these studies relating to inflammation provide further support for the utility of oils comprising GLA and EPA (while the use of GLA in the absence of EPA supplementation may be contraindicated). A method for production of GLA in *Yarrowia lipolytica* is taught in PCT Publication No. 2006/033723.

DESCRIPTION OF PREFERRED EMBODIMENTS

Demonstrated herein is the synthesis of greater than 53.2% EPA, as a percent of total fatty acids, in the total lipid fraction of the oleaginous yeast, *Yarrowia lipolytica*. As shown in FIG. 3, numerous strains of *Y. lipolytica* were created by integrating various genes into wildtype ATCC #20362 *Y. lipolytica*, wherein each transformant strain was capable of producing different amounts of PUFAs (including EPA). The genotype and complete lipid profile of some representative transformant organisms expressing the Δ9 elongase/Δ8 desaturase pathway are shown below in Tables 7 and 8. Fatty acids are identified as 16:0, 16:1, 18:0, 18:1 (oleic acid), 18:2 (LA), 18:3 (ALA), GLA, 20:2 (EDA), DGLA, ARA, ETA and EPA; and the composition of each is presented as a % of the total fatty acids. "TFAs % DCW" represents the total fatty acids in the cell, as a percent of the dry cell weight.

Oil profiles were obtained by GC analyses from the *Yarrowia* strains grown for 2 days in fermentation medium (FM) and 5 days in high glucose medium (HGM) (see General Methods for media recipes). The GC profile may differ slightly from those provided in the Examples, based on differing growth conditions (e.g., different media, flask or tube growth, and length of growth time, etc.).

TABLE 7

Genotype Of Representative *Yarrowia lipolytica* Strains Expressing The Δ9 Elongase/Δ8 Desaturase Pathway

| | Number Of Genes Added | | | | | | |
| --- | --- | --- | --- | --- | --- | --- | --- |
| Strain | Δ9 ELO | Δ8 | Δ5 | Δ17 | Δ12 | $C_{16/18}$ ELO | CPT1 | Genes Knocked Out |
| Y4001 | 2 | — | — | — | 1 | 1 | — | Leu- |
| Y4036 | 3 | 2 | — | — | 2 | 1 | — | Leu-, unknown 1- |
| Y4069 | 3 | 2 | 3 | — | 2 | 1 | — | Ura-, unknown 1-, unknown 2- |
| Y4070 | 3 | 2 | 3 | — | 2 | 1 | — | Ura-, unknown 1-, unknown 3- |
| Y4084 | 3 | 2 | 3 | 3 | 2 | 1 | — | unknown 1-, unknown 2-, unknown 4- |
| Y4086 | 3 | 2 | 3 | 3 | 2 | 1 | — | YALI0F24167g-*, unknown 1-, unknown 2- |
| Y4127 | 4 | 4 | 3 | 3 | 3 | 1 | — | unknown 1-, unknown 2-, unknown 4-, unknown 5- |
| Y4128 | 4 | 4 | 3 | 3 | 3 | 1 | — | Pex10-, YALI0F24167g-*, unknown 1-, unknown 2- |
| Y4158 | 5 | 5 | 3 | 3 | 4 | 2 | 1 | unknown 1-, unknown 2-, unknown 4-, unknown 5-, unknown 6- |
| Y4184 | 6 | 6 | 4 | 3 | 4 | 3 | 2 | unknown 1-, unknown 2-, unknown 4-, unknown 5-, unknown 6-, unknown 7- |
| Y4217 | 5 | 5 | 4 | 3 | 3 | 2 | 1 | YALI0C18711g-, Pex10-, YALI0F24167g-*, unknown 1-, unknown 3- |
| Y4259 | 6 | 6 | 4 | 3 | 4 | 3 | 2 | YALI0C18711g-, Pex10-, YALI0F24167g-*, unknown 1-, unknown 3-, unknown 8- |
| Y4305 | 7 | 7 | 5 | 3 | 5 | 3 | 2 | SCP2-(YALI0E01298g), YALI0C18711g-, Pex10-, YALI0F24167g-*, unknown 1-, unknown 3-, unknown 8- |

*The YALI0F24167g-gene knockout was the result of disruption in the promoter region of YALI0F24167g.

TABLE 8

Lipid Profile Of Representative *Yarrowia lipolytica* Strains Expressing The Δ9 Elongase/Δ8 Desaturase Pathway

| | Fatty Acid Content (% TFAs) | | | | | | | | | | | |
| --- | --- | --- | --- | --- | --- | --- | --- | --- | --- | --- | --- | --- |
| Strain | 16:0 | 16:1 | 18:0 | 18:1 | 18:2 | 18:3 (ALA) | EDA (20:2) | DGLA | ARA | ETA | EPA | TFAs % DCW |
| Y4001 | 4.3 | 4.4 | 3.9 | 35.9 | 23 | 0 | 23.8 | 0 | 0 | 0 | — | — |
| Y4036 | 7.7 | 3.6 | 1.1 | 14.2 | 32.6 | 0 | 15.6 | 18.2 | 0 | 0 | — | — |
| Y4070 | 8.0 | 5.3 | 3.5 | 14.6 | 42.1 | 0 | 6.7 | 2.4 | 11.9 | — | — | — |
| Y4086 | 3.3 | 2.2 | 4.6 | 26.3 | 27.9 | 6.9 | 7.6 | 1 | 0 | 2 | 9.8 | 28.6 |
| Y4128 | 6.6 | 4 | 2.0 | 8.8 | 19 | 2.1 | 4.1 | 3.2 | 0 | 5.7 | 42.1 | 18.3 |
| Y4158 | 3.2 | 1.2 | 2.7 | 14.5 | 30.4 | 5.3 | 6.2 | 3.1 | 0.3 | 3.4 | 20.5 | 27.3 |
| Y4184 | 3.1 | 1.5 | 1.8 | 8.7 | 31.5 | 4.9 | 5.6 | 2.9 | 0.6 | 2.4 | 28.9 | 23.9 |
| Y4217 | 3.9 | 3.4 | 1.2 | 6.2 | 19.0 | 2.7 | 2.5 | 1.2 | 0.2 | 2.8 | 48.3 | 20.6 |

TABLE 8-continued

Lipid Profile Of Representative *Yarrowia lipolytica* Strains Expressing
The Δ9 Elongase/Δ8 Desaturase Pathway

| | Fatty Acid Content (% TFAs) | | | | | | | | | | | TFAs % |
|---|---|---|---|---|---|---|---|---|---|---|---|---|
| Strain | 16:0 | 16:1 | 18:0 | 18:1 | 18:2 | 18:3 (ALA) | EDA (20:2) | DGLA | ARA | ETA | EPA | DCW |
| Y4259 | 4.4 | 1.4 | 1.5 | 3.9 | 19.7 | 2.1 | 3.5 | 1.9 | 0.6 | 1.8 | 46.1 | 23.7 |
| Y4305 | 2.8 | 0.7 | 1.3 | 4.9 | 17.6 | 2.3 | 3.4 | 2.0 | 0.6 | 1.7 | 53.2 | 27.5 |

As seen in the Tables above, the strain expressing the Δ9 elongase/Δ8 desaturase pathway and producing the most EPA was recombinant strain Y4305 of *Yarrowia lipolytica*. The GC chromatogram obtained for this organism is shown in FIG. 4. A more detailed summary of the genetic modifications contained within strain Y4305 are described below (wherein complete details are provided in the Examples):

(1) Expression of 2 copies of a *Fusarium moniliforme* Δ12 desaturase, within GPD::FmD12::Pex20 and YAT1::FmD12::OCT chimeric genes;

(2) Expression of 3 copies of a synthetic Δ12 desaturase gene (codon-optimized for expression in *Y. lipolytica*) derived from the *Fusarium moniliforme* Δ12 desaturase, within GPM/FBAIN::FmD12S::OCT, EXP1::FmD12S::Aco and YAT1::FmD12S::Lip2 chimeric genes;

(3) Expression of 3 copies of a synthetic $C_{16/18}$ elongase gene (codon-optimized for expression in *Y. lipolytica*) derived from the *Mortierella alpina* $C_{16/18}$ elongase, within YAT1::ME3S::Pex16 and EXP1::ME3S::Pex20 chimeric genes;

(4) Expression of 1 copy of a *Euglena gracilis* Δ9 elongase, within a GPAT::EgD9e::Lip2 chimeric gene;

(5) Expression of 5 copies of a synthetic Δ9 elongase gene (codon-optimized for expression in *Y. lipolytica*) derived from the *Euglena gracilis* Δ9 elongase, within EXP1::EgD9eS::Lip1, FBAINm::EgD9eS::Lip2, FBA::EgD9eS::Pex20, GPD::EgD9eS::Lip2 and YAT1::EgD9eS::Lip2 chimeric genes;

(6) Expression of 1 copy a synthetic Δ9 elongase gene (codon-optimized for expression in *Y. lipolytica*) derived from the *Eutreptiella* sp. CCMP389 Δ9 elongase, within a YAT1::E389D9eS::Oct chimeric gene;

(7) Expression of 7 copies of a mutant Δ8 desaturase gene derived from a synthetic Δ8 desaturase (derived from the *Euglena gracilis* Δ8 desaturase and codon-optimized for expression in *Y. lipolytica*), within FBAINm::EgD8M::Pex20, EXP1::EgD8M::Pex16, GPDIN::EgD8M::Lip1, YAT1::EgD8M::Aco, and FBAIN::EgD8M::Lip1 chimeric genes;

(8) Expression of 1 copy of a *Euglena gracilis* Δ5 desaturase within a FBAIN::EgD5::Aco chimeric gene;

(9) Expression of 3 copies of a synthetic Δ5 desaturase gene (codon-optimized for expression in *Y. lipolytica*) derived from the *Euglena gracilis* Δ5 desaturase, within EXP1::EgD5S::Pex20, YAT1::RD5S::OCT, YAT1::EgD5S::Aco and EXP1::EgD5S::Aco chimeric genes;

(10) Expression of 1 copy of a synthetic Δ5 desaturase gene (codon-optimized for expression in *Y. lipolytica*) derived from the *Peridinium* sp. CCMP626 Δ5 desaturase, within a YAT1::RD5S::OCT chimeric gene;

(11) Expression of 2 copies of a *Pythium aphanidermatum* Δ17 desaturase within EXP1::PaD17::Pex16 and FBAINm::PaD17::Aco chimeric genes;

(12) Expression of 1 copy of a synthetic Δ17 desaturase gene (codon-optimized for expression in *Y. lipolytica*) derived from the *Pythium aphanidermatum* Δ17 desaturase within a YAT1::PaD17S::Lip1 chimeric gene;

(13) Expression of 2 copies of a *Yarrowia lipolytica* diacylglycerol cholinephosphotransferase within YAT1::YlCPT1::Aco and GPD::YlCPT1::Aco chimeric genes;

(14) Disruption of a native *Yarrowia lipolytica* gene encoding the peroxisome biogenesis factor 10 protein (PEX10);

(15) Disruption of a native *Yarrowia lipolytica* gene encoding SCP2 (YALI0E01298g; GenBank Accession No. XM_503410);

(16) Disruption of a native *Yarrowia lipolytica* gene encoding YALI0C18711g (GenBank Accession No. XP_501987); and,

(17) Disruption of a native *Yarrowia lipolytica* gene encoding YALI0F24167g (GenBank Accession No. XM_505819).

Accordingly, a microbial oil having the following fatty acid concentrations as a weight percent of the total fatty acids is thus described:

a) from about 48% to about 55% EPA;
b) from about 1.5% to about 3.0% ETA;
c) from about 0.1% to 0.7% ARA;
d) from about 1.0% to about 2.5% DGLA;
e) from about 2.0% to about 3.5% EDA;
f) from about 2.0% to about 3.0% ALA;
g) from about 17.0% to about 20.0% linoleic acid (18:2);
h) from about 3.5% to about 6.5% oleic acid (18:1);
i) from about 1.0% to about 2.0% stearic acid (18:0);
j) from about 0.5% to about 3.5% palmitoleic (16:1); and
k) from about 2.5% to about 4.5% palmitic acid (16:0).

In alternate embodiments, a microbial oil is provided herein, wherein said oil has the following fatty acid concentrations as a weight percent of the total fatty acids:

a) at least about 43.3% EPA;
b) less than about 23.6% LA (18:2); and
c) less than about 9.4% oleic acid (18:1).

In more preferred embodiments, the microbial oil additionally comprises less than about 4.2% EDA as a weight percent of the total fatty acids.

Although the Applicants demonstrate production of up to 55.6% EPA, as a weight percent of the total fatty acids, in these particular recombinant strains of *Yarrowia lipolytica*, it is contemplated that the concentration of EPA in the host cells could be significantly modified via additional genetic modifications, as described herein. This could result in increased production of EPA or production of a *Yarrowia lipolytica* oil comprising EPA and at least one other ω-3 and/or ω-6 PUFA. Furthermore, on the basis of the teachings and results described herein, it is expected that one skilled in the art will recognize the feasibility and commercial utility created by using oleaginous yeast as a production platform for the synthesis of a variety of ω-3 and/or ω-6 PUFAs, using the Δ9 elongase/Δ8 desaturase pathway.

EXAMPLES

The present invention is further defined in the following Examples. It should be understood that these Examples, while indicating preferred embodiments of the invention, are given by way of illustration only. From the above discussion and these Examples, one skilled in the art can ascertain the essential characteristics of this invention, and without departing from the spirit and scope thereof, can make various changes and modifications of the invention to adapt it to various usages and conditions.

General Methods

Standard recombinant DNA and molecular cloning techniques used in the Examples are well known in the art and are described by: 1) Sambrook, J., Fritsch, E. F. and Maniatis, T. *Molecular Cloning: A Laboratory Manual*; Cold Spring Harbor Laboratory: Cold Spring Harbor, N.Y. (1989) (Maniatis); 2) T. J. Silhavy, M. L. Bennan, and L. W. Enquist, Experiments with Gene Fusions; Cold Spring Harbor Laboratory: Cold Spring Harbor, N.Y. (1984); and, 3) Ausubel, F. M. et al., Current Protocols in Molecular Biology, published by Greene Publishing Assoc. and Wiley-Interscience, Hoboken, N.J. (1987).

Materials and methods suitable for the maintenance and growth of microbial cultures are well known in the art. Techniques suitable for use in the following examples may be found as set out in Manual of Methods for General Bacteriology (Phillipp Gerhardt, R. G. E. Murray, Ralph N. Costilow, Eugene W. Nester, Willis A. Wood, Noel R. Krieg and G. Briggs Phillips, Eds), American Society for Microbiology: Washington, D.C. (1994)); or by Thomas D. Brock in Biotechnology: A Textbook of Industrial Microbiology, $2^{nd}$ ed., Sinauer Associates: Sunderland, Mass. (1989). All reagents, restriction enzymes and materials used for the growth and maintenance of microbial cells were obtained from Aldrich Chemicals (Milwaukee, Wis.), DIFCO Laboratories (Detroit, Mich.), New England Biolabs, Inc. (Beverly, Mass.), GIBCO/BRL (Gaithersburg, Md.), or Sigma Chemical Company (St. Louis, Mo.), unless otherwise specified. *E. coli* strains were typically grown at 37° C. on Luria Bertani (LB) plates.

General molecular cloning was performed according to standard methods (Sambrook et al., supra). Oligonucleotides were synthesized by Sigma-Genosys (Spring, Tex.). Individual PCR amplification reactions were carried out in a 50 μl total volume, comprising: PCR buffer (containing 10 mM KCl, 10 mM $(NH_4)_2SO_4$, 20 mM Tris-HCl (pH 8.75), 2 mM $MgSO_4$, 0.1% Triton X-100), 100 μg/mL BSA (final concentration), 200 μM each deoxyribonucleotide triphosphate, 10 pmole of each primer and 1 μl of Pfu DNA polymerase (Stratagene, San Diego, Calif.), unless otherwise specified. Site-directed mutagenesis was performed using Stratagene's QuickChange™ Site-Directed Mutagenesis kit, per the manufacturer's instructions. When PCR or site-directed mutagenesis was involved in subcloning, the constructs were sequenced to confirm that no errors had been introduced to the sequence. PCR products were cloned into Promega's pGEM-T-easy vector (Madison, Wis.).

DNA sequence was generated on an ABI Automatic sequencer using dye terminator technology (U.S. Pat. No. 5,366,860; EP 272,007) using a combination of vector and insert-specific primers. Sequence editing was performed in Sequencher (Gene Codes Corporation, Ann Arbor, Mich.). All sequences represent coverage at least two times in both directions. Comparisons of genetic sequences were accomplished using DNASTAR software (DNA Star, Inc.). Alternatively, manipulations of genetic sequences were accomplished using the suite of programs available from the Genetics Computer Group Inc. (Wisconsin Package Version 9.0, Genetics Computer Group (GCG), Madison, Wis.). The GCG program "Pileup" was used with the gap creation default value of 12, and the gap extension default value of 4. The GCG "Gap" or "Bestfit" programs were used with the default gap creation penalty of 50 and the default gap extension penalty of 3. Unless otherwise stated, in all other cases GCG program default parameters were used.

BLAST (Basic Local Alignment Search Tool; Altschul, S. F., et al., *J. Mol. Biol.*, 215:403-410 (1993) and *Nucleic Acids Res.*, 25:3389-3402 (1997)) searches were conducted to identity isolated sequences having similarity to sequences contained in the BLAST "nr" database (comprising all non-redundant GenBank CDS translations, sequences derived from the 3-dimensional structure Brookhaven Protein Data Bank, the SWISS-PROT protein sequence database, EMBL and DDBJ databases). Sequences were translated in all reading frames and compared for similarity to all publicly available protein sequences contained in the "nr" database, using the BLASTX algorithm (Gish, W. and States, D. J. *Nature Genetics*, 3:266-272 (1993)) provided by the NCBI.

The results of BLAST comparisons summarizing the sequence to which a query sequence had the most similarity are reported according to the % identity, % similarity, and Expectation value. "% Identity" is defined as the percentage of amino acids that are identical between the two proteins. "% Similarity" is defined as the percentage of amino acids that are identical or conserved between the two proteins. "Expectation value" estimates the statistical significance of the match, specifying the number of matches, with a given score, that are expected in a search of a database of this size absolutely by chance.

The meaning of abbreviations is as follows: "sec" means second(s), "min" means minute(s), "h" means hour(s), "d" means day(s), "μL" means microliter(s), "mL" means milliliter(s), "L" means liter(s), "μM" means micromolar, "mM" means millimolar, "M" means molar, "mmol" means millimole(s), "μmole" mean micromole(s), "g" means gram(s), "μg" means microgram(s), "ng" means nanogram(s), "U" means unit(s), "bp" means base pair(s), "kB" means kilobase(s), "DCW" means dry cell weight, and "TFAs" means total fatty acids.

Nomenclature for Expression Cassettes

The structure of an expression cassette will be represented by a simple notation system of "X::Y::Z", wherein X describes the promoter fragment, Y describes the gene fragment, and Z describes the terminator fragment, which are all operably linked to one another.

Transformation and Cultivation of *Yarrowia lipolytica*

*Yarrowia lipolytica* strain ATCC #20362 was purchased from the American Type Culture Collection (Rockville, Md.). *Yarrowia lipolytica* strains were routinely grown at 28-30° C. in several media, according to the recipes shown below. Agar plates were prepared as required by addition of 20 g/L agar to each liquid media, according to standard methodology.

YPD agar medium (per liter): 10 g of yeast extract [Difco], 20 g of Bacto peptone [Difco], and 20 g of glucose.

Basic Minimal Media (MM) (per liter): 20 g glucose, 1.7 g yeast nitrogen base without amino acids, 1.0 g proline, and pH 6.1 (not adjusted).

Minimal Media+Uracil (MM+uracil or MMU) (per liter): Prepare MM media as above and add 0.1 g uracil and 0.1 g uridine.

Minimal Media+Uracil+Sulfonylurea (MMU+SU) (per liter): Prepare MMU media as above and add 280 mg sulfonylurea.

Minimal Media+Leucine+Lysine (MMLeuLvs) (per liter): Prepare MM media as above and add 0.1 g leucine and 0.1 g lysine.

Minimal Media+5-Fluoroorotic Acid (MM+5-FOA) (per liter): 20 g glucose, 6.7 g Yeast Nitrogen base, 75 mg uracil, 75 mg uridine and appropriate amount of FOA (Zymo Research Corp., Orange, Calif.), based on FOA activity testing against a range of concentrations from 100 mg/L to 1000 mg/L (since variation occurs within each batch received from the supplier).

High Glucose Media (HGM) (per liter): 80 glucose, 2.58 g $KH_2PO_4$ and 5.36 g $K_2HPO_4$, pH 7.5 (do not need to adjust).

Fermentation medium without Yeast Extract (FM without YE) (per liter): 6.70 g/L Yeast nitrogen base, 6.00 g $KH_2PO_4$, 2.00 g $K_2HPO_4$, 1.50 g $MgSO_4*7H_2O$, and 20 g glucose.

Fermentation medium (FM) (per liter): Prepare FM without YE media as above and add 5.00 g Yeast extract (BBL).

Transformation of *Y. lipolytica* was performed according to the method of Chen, D. C. et al. (*Appl. Microbiol. Biotechnol.*, 48(2):232-235 (1997)), unless otherwise noted. Briefly, *Yarrowia* was streaked onto a YPD plate and grown at 30° C. for approximately 18 hr. Several large loopfuls of cells were scraped from the plate and resuspended in 1 mL of transformation buffer containing: 2.25 mL of 50% PEG, average MW 3350; 0.125 mL of 2 M Li acetate, pH 6.0; and 0.125 mL of 2 M DTT. Then, approximately 500 ng of linearized plasmid DNA was incubated in 100 µl of resuspended cells, and maintained at 39° C. for 1 hr with vortex mixing at 15 min intervals. The cells were plated onto selection media plates and maintained at 30° C. for 2 to 3 days.

Fatty Acid Analysis of *Yarrowia lipolytica*

For fatty acid analysis, cells were collected by centrifugation and lipids were extracted as described in Bligh, E. G. & Dyer, W. J. (*Can. J. Biochem. Physiol.*, 37:911-917 (1959)). Fatty acid methyl esters ["FAMEs"] were prepared by transesterification of the lipid extract with sodium methoxide (Roughan, G., and Nishida I. *Arch Biochem Biophys.*, 276(1): 38-46 (1990)) and subsequently analyzed with a Hewlett-Packard 6890 GC fitted with a 30-m×0.25 mm (i.d.) HP-INNOWAX (Hewlett-Packard) column. The oven temperature was from 170° C. (25 min hold) to 185° C. at 3.5° C./min.

For direct base transesterification, *Yarrowia* culture (3 mL) was harvested, washed once in distilled water, and dried under vacuum in a Speed-Vac for 5-10 min. Sodium methoxide (100 µl of 1%) was added to the sample, and then the sample was vortexed and rocked for 20 min. After adding 3 drops of 1 M NaCl and 400 µl hexane, the sample was vortexed and spun. The upper layer was removed and analyzed by GC as described above.

Example 1

Generation of *Yarrowia lipolytica* Strain Y4086 to Produce about 14% EPA of Total Lipids Via the Δ9 Elongase/Δ8 Desaturase Pathway The present Example describes the construction of strain Y4086, derived from *Yarrowia lipolytica* ATCC #20362, capable of producing about 14% EPA relative to the total lipids via expression of a Δ9 elongase/Δ8 desaturase pathway (FIG. 3).

The development of strain Y4086 required the construction of strain Y2224 (a FOA resistant mutant from an autonomous mutation of the Ura3 gene of wildtype *Yarrowia* strain ATCC #20362), strain Y4001 (producing 17% EDA with a Leu– phenotype), strain Y4001U (Leu– and Ura– phenotype), strain Y4036 (producing 18% DGLA with a Leu– phenotype), strain Y4036U (Leu– and Ura– phenotype) and strain Y4070 (producing 12% ARA with a Ura– phenotype). Further details regarding the construction of strains Y2224, Y4001, Y4001U, Y4036, Y4036U and Y4070 are described in Example 7 of PCT Publication No. WO 2008/073367, hereby incorporated herein by reference.

The final genotype of strain Y4070 with respect to wildtype *Yarrowia lipolytica* ATCC #20362 was Ura–, unknown 1–, unknown 3–, Leu+, Lys+, GPD::FmD12::Pex20, YAT1:: FmD12::OCT, YAT1::ME3S::Pex16, GPAT::EgD9e::Lip2, EXP1::EgD9eS::Lip1, FBAINm::EgD9eS::Lip2, FBAINm:: EgD8M::Pex20, EXP1::EgD8M::Pex16, FBAIN::EgD5:: Aco, EXP1::EgD5S::Pex20, YAT1::RD5S::OCT.

Generation of Y4086 Strain to Produce about 14% EPA of Total Lipids

Figures 5A, 5B:
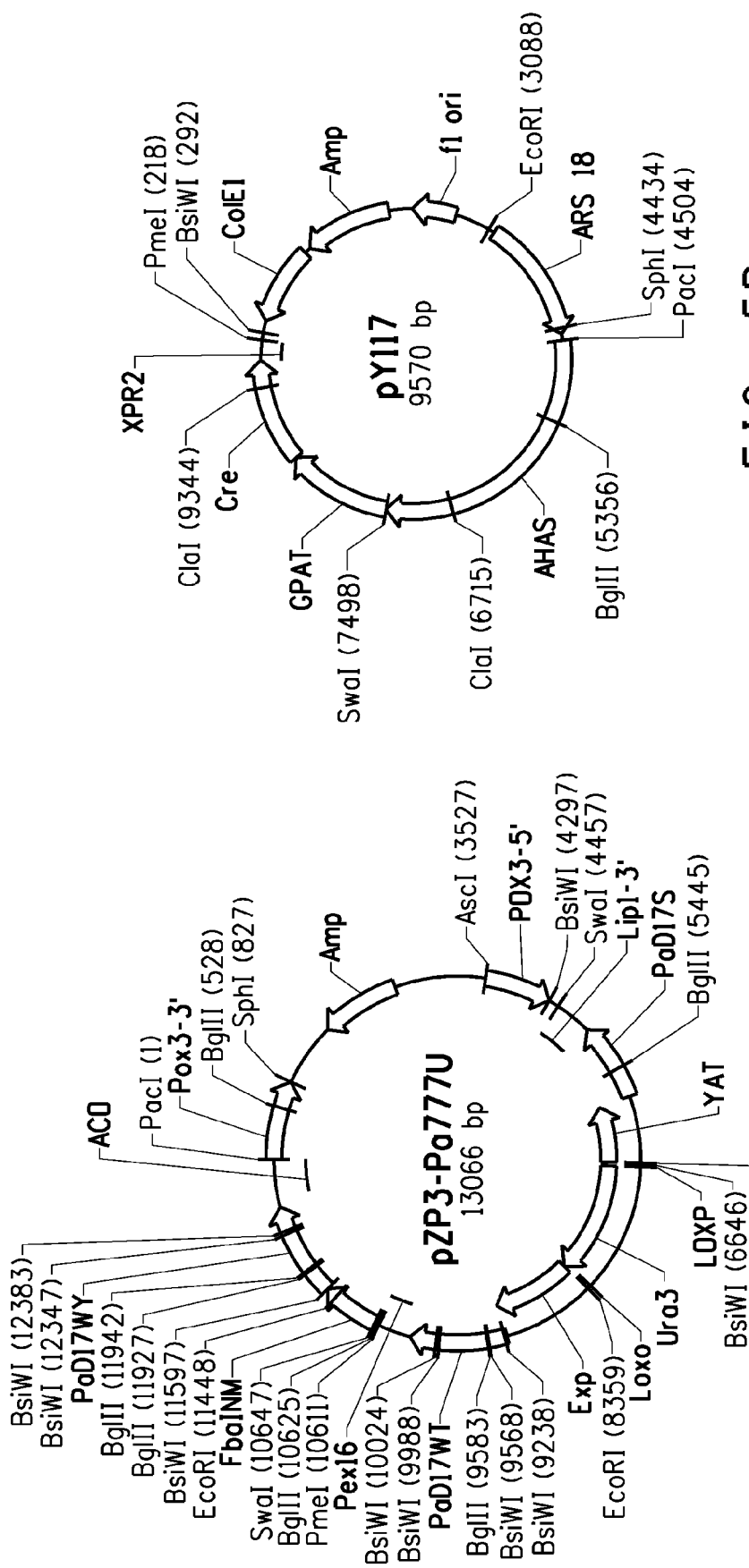

Construct pZP3-Pa777U (FIG. 5A; SEQ ID NO:127) was generated to integrate three Δ17 desaturase genes into the Pox3 loci (GenBank Accession No. AJ001301) of strain Y4070, to thereby enable production of EPA. The pZP3-Pa777U plasmid contained the following components:

TABLE 9

Description of Plasmid pZP3-Pa777U (SEQ ID NO: 127)

| RE Sites And Nucleotides Within SEQ ID NO: 127 | Description Of Fragment And Chimeric Gene Components |
|---|---|
| AscI/BsiWI (3527-4297) | 770 bp 5' portion of *Yarrowia* Pox3 gene (GenBank Accession No. AJ001301) |
| PacI/SphI (1-827) | 827 bp 3' portion of *Yarrowia* Pox3 gene (GenBank Accession No. AJ001301) |
| ClaI/SwaWI (6624-4457) | YAT1::PaD17S::Lip1, comprising: YAT1: *Yarrowia lipolytica* YAT1 promoter (labeled as "YAT" in Figure; Patent Publication US 2006/0094102-A1); PaD17S: codon-optimized Δ17 desaturase (SEQ ID NO: 52), derived from *Pythium aphanidermatum* (PCT Publication No. WO 2008/054565); Lip1: Lip1 terminator sequence from *Yarrowia* Lip1 gene (GenBank Accession No. Z50020) |
| EcoRI/PmeI (8359-10611) | EXP1::PaD17::Pex16, comprising: EXP1: *Yarrowia lipolytica* export protein (EXP1) promoter (labeled as "Exp" in Figure; PCT Publication No. WO 2006/052870); PaD17: *Pythium aphanidermatum* Δ17 desaturase gene (SEQ ID NO: 50) (labeled as "PaD17WT" in Figure; PCT Publication No. WO 2008/054565); Pex16: Pex16 terminator sequence from *Yarrowia* Pex16 gene (GenBank Accession No. U75433) |
| PmeI/PacI (10611-1) | FBAINm::PaD17::Aco, comprising: FBAINm: *Yarrowia lipolytica* FBAINm promoter (U.S. Pat. No. 7,202,356); PaD17: *Pythium aphanidermatum* Δ17 desaturase gene (SEQ ID NO: 50) (labeled as "PaD17WT" in Figure; PCT Publication No. WO 2008/054565); Aco: Aco terminator sequence from *Yarrowia* Aco gene (GenBank Accession No. AJ001300) |
| ClaI/EcoRI (6624-8359) | LoxP::Ura3::LoxP, comprising: LoxP sequence (SEQ ID NO: 123); *Yarrowia* Ura3 gene (GenBank Accession No. AJ306421); LoxP sequence (SEQ ID NO: 123) |

The pZP3-Pa777U plasmid was digested with AscI/SphI, and then used for transformation of strain Y4070 according to the General Methods. The transformant cells were plated onto MM plates and maintained at 30° C. for 2 to 3 days. Single colonies were then re-streaked onto MM plates, and then inoculated into liquid MMLeuLys at 30° C. and shaken at 250 rpm/min for 2 days. The cells were collected by centrifugation, lipids were extracted, and FAMEs were prepared by trans-esterification, and subsequently analyzed with a Hewlett-Packard 6890 GC.

GC analyses showed the presence of EPA in the transformants containing the 3 chimeric genes of pZP3-Pa777U, but not in the parent Y4070 strain. Most of the selected 96 strains produced 10-13% EPA of total lipids. There were 2 strains (i.e., #58 and #79) that produced about 14.2% and 13.8% EPA of total lipids. These two strains were designated as Y4085 and Y4086, respectively.

The final genotype of strain Y4086 with respect to wildtype Yarrowia lipolytica ATCC #20362 was Ura3+, Leu+, Lys+, unknown 1−, unknown 2−, YALI0F24167g−, GPD::FmD12:: Pex20, YAT1::FmD12::OCT, YAT1::ME3S::Pex16, GPAT:: EgD9e::Lip2, EXP1::EgD9eS::Lip1, FBAINm::EgD9eS:: Lip2, FBAINm::EgD8M::Pex20, EXP1::EgD8M::Pex16, FBAIN::EgD5::Aco, EXP1::EgD5S::Pex20, YAT1::RD5S:: OCT, YAT1::PaD17S::Lip1, EXP1::PaD17::Pex16, FBAINm::PaD17::Aco.

Example 2

Generation of Yarrowia lipolytica Strain Y4128 to Produce about 37% EPA of Total Lipids Via the Δ9 Elongase/Δ8 Desaturase Pathway The present Example describes the construction of strain Y4128, derived from Yarrowia lipolytica ATCC #20362, capable of producing about 37.6% EPA relative to the total lipids (i.e., greater than a 2-fold increase in EPA concentration as percent of total fatty acids with respect to Y4086).

The development of strain Y4128 required the construction of strains Y2224, Y4001, Y4001U, Y4036, Y4036U, Y4070 and Y4086 (described in Example 1), as well as construction of strain Y4086U1 (Ura−).

Generation of Strain Y4086U1 (Ura−)

Strain Y4086U1 was created via temporary expression of the Cre recombinase enzyme in construct pY117 (FIG. 5B; SEQ ID NO:128; described in PCT Publication No. WO 2008/073367) within strain Y4086 to produce a Ura− phenotype. This released the LoxP sandwiched Ura3 gene from the genome. The mutated Yarrowia acetohydroxyacid synthase enzyme (i.e., "AHAS"; E.C. 4.1.3.18; GenBank Accession No. XP_501277, comprising a W497L mutation as set forth in SEQ ID NO:121; see PCT Publication No. WO 2006/052870) in plasmid pY117 conferred sulfonyl urea herbicide resistance ($SU^R$), which was used as a positive screening marker.

Plasmid pY117 was derived from plasmid pY116 (described in Example 7 of PCT Publication No. WO 2008/073367) by inserting the mutant AHAS gene flanked by PacI-SwaI sites into PacI-SwaI digested pY116, thereby replacing the LEU selectable marker with the sulfonylurea marker. Construct pY117 thereby contained the following components:

TABLE 10

Description of Plasmid pY117 (SEQ ID NO: 128)

| RE Sites And Nucleotides Within SEQ ID NO: 128 | Description Of Fragment And Chimeric Gene Components |
|---|---|
| 1328-448 | ColE1 plasmid origin of replication |
| 2258-1398 | Ampicillin-resistance gene ($Amp^R$) for selection in E. coli |
| 2438-2838 | E. coli f1 origin of replication |
| 3157-4461 | Yarrowia autonomous replication sequence (ARS18; GenBank Accession No. A17608) |
| PacI/SwaI 4504-7498 | Yarrowia lipolytica AHAS gene (GenBank Accession No. XP_501277) comprising a W497L mutation (SEQ ID NO: 121; PCT Publication No. WO 2006/052870) |
| SwaI/PmeI 7498-218 | GPAT::Cre::XPR, comprising:<br>GPAT: Yarrowia lipolytica GPAT promoter (U.S. Pat. No. 7,264,949);<br>Cre: Enterobacteria phage P1 Cre gene for recombinase protein (GenBank Accession No. X03453) except for single base change (T4G) resulting in a single amino acid change (S2A) to create a NcoI site for cloning convenience;<br>XPR: ~100 bp of the 3' region of the Yarrowia Xpr gene (GenBank Accession No. M17741) |

Plasmid pY117 was used to transform strain Y4086 according to the General Methods. Following transformation, the cells were plated onto MMU+SU (280 g/mL sulfonylurea; also known as chlorimuron ethyl, E.I. duPont de Nemours & Co., Inc., Wilmington, Del.) plates and maintained at 30° C. for 2 to 3 days. The individual $SU^R$ colonies grown on MMU+SU plates were picked, and streaked into YPD liquid media at 30° C. and shaken at 250 rpm/min for 1 day to cure the pY117 plasmid. The grown cultures were streaked onto MMU plates. After two days at 30° C., the individual colonies were re-streaked onto MM and MMU plates. Those colonies that could grow on MMU, but not on MM plates, were selected. Two of these strains with Ura− phenotypes were designated as Y4086U1 and Y4086U2.

Generation of Y4128 Strain to Produce about 37% EPA of Total Lipids

Figures 6A, 6B:
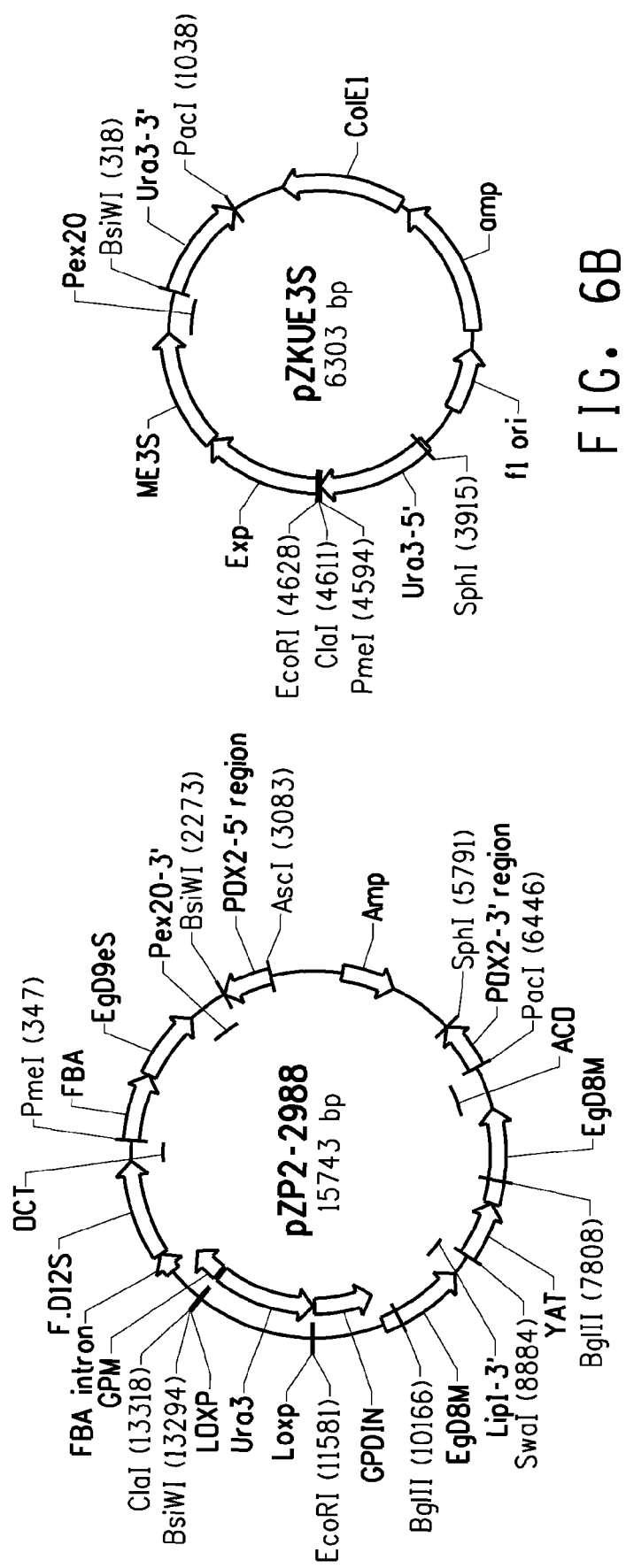

Construct pZP2-2988 (FIG. 6A; SEQ ID NO:129) was generated to integrate one Δ12 desaturase gene, two Δ8 desaturase genes and one Δ9 elongase gene into the Pox2 loci (GenBank Accession No. AJ001300) of strain Y4086U1, to thereby enable higher level production of EPA. The pZP2-2988 plasmid contained the following components:

TABLE 11

Description of Plasmid pZP2-2988 (SEQ ID NO: 129)

| RE Sites And Nucleotides Within SEQ ID NO: 129 | Description Of Fragment And Chimeric Gene Components |
|---|---|
| AscI/BsiWI (3083-2273) | 803 bp 5' portion of Yarrowia Pox2 gene (GenBank Accession No. AJ001300) |
| PacI/SphI (6446-5791) | 649 bp 3' portion of Yarrowia Pox2 gene (GenBank Accession No. AJ001300) |
| PmeI/BsiWI (347-2273) | FBA::EgD9eS::Pex20, comprising:<br>FBA: Yarrowia lipolytica FBA promoter (U.S. Pat. No. 7,202,356);<br>EgD9eS: codon-optimized Δ9 elongase (SEQ ID NO: 6), derived from Euglena gracilis (PCT Publication No. WO 2007/061742);<br>Pex20: Pex20 terminator sequence from Yarrowia Pex20 gene (GenBank Accession No. AF054613) |
| ClaI/PmeI (13318-347) | GPM/FBAIN::FmD12S::OCT, comprising:<br>GPM/FBAIN: chimeric Yarrowia lipolytica |

TABLE 11-continued

Description of Plasmid pZP2-2988 (SEQ ID NO: 129)

| RE Sites And Nucleotides Within SEQ ID NO: 129 | Description Of Fragment And Chimeric Gene Components |
|---|---|
| | GPM/FBAIN promoter (separately labeled as "GPM" and "FBA intron" in Figure) (U.S. Pat. No. 7,202,356); FmD12S: codon-optimized Δ12 desaturase (SEQ ID NO: 56), derived from *Fusarium moniliforme* (labeled as "F.D12S" in Figure; PCT Publication No. WO 2005/047485); OCT: OCT terminator sequence of *Yarrowia* OCT gene (GenBank Accession No. X69988) |
| ClaI/EcoRI (13318-11581) | LoxP::Ura3::LoxP, comprising: LoxP sequence (SEQ ID NO: 123); *Yarrowia* Ura3 gene (GenBank Accession No. AJ306421); LoxP sequence (SEQ ID NO: 123) |
| EcoRII/SwaI (11581-8884) | GPDIN::EgD8M::Lip1, comprising: GPDIN: *Yarrowia lipolytica* GPDIN promoter (Patent Publication US 2006/0019297-A1); EgD8M: Synthetic mutant Δ8 desaturase (SEQ ID NO: 22; Patent Publication US 2008-0138868 A1), derived from *Euglena gracilis* ("EgD8S"; U.S. Pat. No. 7,256,033); Lip1: Lip1 terminator sequence from *Yarrowia* Lip1 gene (GenBank Accession No. Z50020) |
| SwaI/PacI (8884-6446) | YAT1::EgD8M::ACO, comprising: YAT1: *Yarrowia lipolytica* YAT1 promoter (labeled as "YAT" in Figure; Patent Publication U.S. 2006/0094102-A1); EgD8M: Synthetic mutant Δ8 desaturase (SEQ ID NO: 22; Patent Publication US 2008-0138868 A1), derived from *Euglena gracilis* ("EgD8S"; US Pat. No. 7,256,033); Aco: Aco terminator sequence from *Yarrowia* Aco gene (GenBank Accession No. AJ001300) |

The pZP2-2988 plasmid was digested with AscI/SphI, and then used for transformation of strain Y4086U1 according to the General Methods. The transformant cells were plated onto MM plates and maintained at 30° C. for 2 to 3 days. Single colonies were re-streaked onto MM plates, and then inoculated into liquid MMLeuLys at 30° C. and shaken at 250 rpm/min for 2 days. The cells were collected by centrifugation, resuspended in HGM and then shaken at 250 rpm/min for 5 days. The cells were collected by centrifugation, lipids were extracted, and FAMEs were prepared by trans-esterification, and subsequently analyzed with a Hewlett-Packard 6890 GC.

GC analyses showed that most of the selected 96 strains produced 12-15.6% EPA of total lipids. There were 2 strains (i.e., #37 within Group I and #33 within Group II) that produced about 37.6% and 16.3% EPA of total lipids. These two strains were designated as Y4128 and Y4129, respectively.

The final genotype of strain Y4128 with respect to wildtype *Yarrowia lipolytica* ATCC #20362 was: YALI0F24167g–, Pex10–, unknown 1–, unknown 2–, GPD::FmD12::Pex20, YAT1::FmD12::OCT, GPM/FBAIN::FmD12S::OCT, YAT1::ME3S::Pex16, GPAT::EgD9e::Lip2, EXP1::EgD9eS::Lip1, FBAINm::EgD9eS::Lip2, FBA::EgD9eS::Pex20, FBAINm::EgD8M::Pex20, EXP1::EgD8M::Pex16, GPDIN::EgD8M::Lip1, YAT1::EgD8M::Aco, FBAIN::EgD5::Aco, EXP1::EgD5S::Pex20, YAT1::RD5S::OCT, YAT1::PaD17S::Lip1, EXP1::PaD17::Pex16, FBAINm::PaD17::Aco. *Yarrowia lipolytica* strain Y4128 was deposited with the American Type Culture Collection on Aug. 23, 2007 and bears the designation ATCC PTA-8614.

Example 3

Generation of Optimized *Yarrowia lipolytica* Strain Y4305 to Produce Greater than 53% EPA of Total Lipids Via the Δ9 Elongase/Δ8 Desaturase Pathway The present Example describes the construction of strain Y4305, derived from *Yarrowia lipolytica* ATCC #20362, capable of producing greater than 53% EPA relative to the total lipids via expression of a Δ9 elongase/Δ8 desaturase pathway (FIG. 3).

The development of strain Y4305 required the construction of strains Y2224, Y4001, Y4001U, Y4036, Y4036U, Y4070 and Y4086 (described in Example 1), strains Y4086U1 and Y4128 (described in Example 2), as well as strain Y4128U3 (Ura–), Y4217 (producing 42% EPA of total lipids), Y4217U2 (Ura–), Y4259 (producing 46.5% EPA of total lipids) and Y4259U2 (Ura–).

Generation of Y4128U Strains

In order to disrupt the Ura3 gene in strain Y4128, construct pZKUE3S (FIG. 6B; SEQ ID NO:130) was created to integrate a EXP1::ME3S::Pex20 chimeric gene into the Ura3 gene of strain Y4128. Plasmid pZKUE3S contained the following components:

TABLE 12

Description of Plasmid pZKUE3S (SEQ ID NO: 130)

| RE Sites And Nucleotides Within SEQ ID NO: 130 | Description Of Fragment And Chimeric Gene Components |
|---|---|
| BsiWI/PacI (318-1038) | 721 bp 5' portion of *Yarrowia* Ura3 gene (GenBank Accession No. AJ306421) |
| SphI/PmeI (3915-4594) | 729 bp 3' portion of *Yarrowia* Ura3 gene (GenBank Accession No. AJ306421) |
| EcoRI/BsiWI (4628-318) | EXP1::ME3S::Pex20, comprising: EXP1: *Yarrowia lipolytica* export protein (EXP1) promoter (labeled as "Exp" in Figure; PCT Publication No. WO 2006/052870); ME3S: codon-optimized $C_{16/18}$ elongase gene (SEQ ID NO: 60), derived from *Mortierella alpina* (PCT Publication No. WO 2007/046817); Pex20: Pex20 terminator sequence of *Yarrowia* Pex20 gene (GenBank Accession No. AF054613) |
| 2149-1269 | ColE1 plasmid origin of replication |
| 3079-2219 | ampicillin-resistance gene ($Amp^R$) for selection in *E. coli* |
| 3659-3259 | f1 origin |

Plasmid pZKUE3S was digested with SphI/PacI, and then used to transform strain Y4128 according to the General Methods. Following transformation, cells were plated onto MM+5-FOA selection plates and maintained at 30° C. for 2 to 3 days.

A total of 24 transformants grown on MM+5-FOA selection plates were picked and re-streaked onto fresh MM+5-FOA plates. The cells were stripped from the plates, lipids were extracted, and FAMEs were prepared by trans-esterification, and subsequently analyzed with a Hewlett-Packard 6890 GC.

GC analyses showed the presence of between 10-15% EPA of total lipids in all of the transformants with pZKUE3S from plates. The strains identified as #3, #4, #10, #12, #19 and #21 that produced 12.9%, 14.4%, 15.2%, 15.4%, 14% and 10.9% EPA of total lipids were designated as Y4128U1, Y4128U2, Y4128U3, Y4128U4, Y4128U5 and Y4128U6, respectively (collectively, Y4128U).

The discrepancy in the % EPA quantified in Y4128 (37.6%, as described in Example 2) versus Y4128U (average 13.8%, supra) is based on differing growth conditions. Specifically, the former culture was analyzed following two days of growth in liquid culture, while the latter culture was analyzed after growth on an agar plate. The Applicants have observed a 2-3 fold increase in % EPA of total lipids, when comparing results from agar plates to those in liquid culture. Thus, although results are not directly comparable, both Y4128 and Y4128U strains demonstrate high production of EPA.

Generation of Y4217 Strain to Produce about 42% EPA of Total Lipids

Figures 7A, 7B:
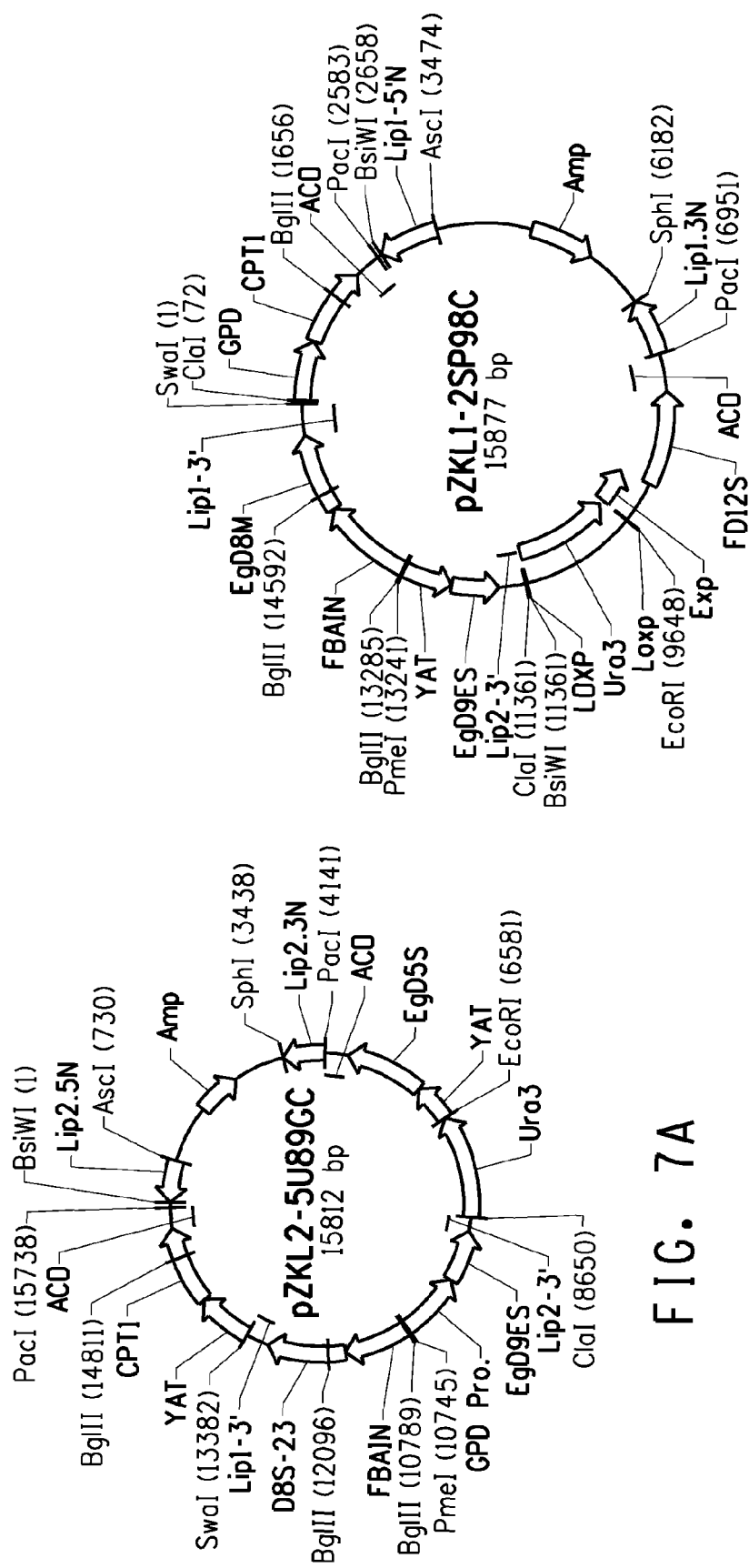

Construct pZKL2-5U89GC (FIG. 7A; SEQ ID NO:131) was generated to integrate one Δ9 elongase gene, one Δ8 desaturase gene, one Δ5 desaturase gene and one *Yarrowia lipolytica* diacylglycerol cholinephosphotransferase gene (CPT1) into the Lip2 loci (GenBank Accession No. AJ012632) of strain Y4128U3 to thereby enable higher level production of EPA. The pZKL2-5U89GC plasmid contained the following components:

TABLE 13

Description of Plasmid pZKL2-5U89GC (SEQ ID NO: 131)

| RE Sites And Nucleotides Within SEQ ID NO: 131 | Description Of Fragment And Chimeric Gene Components |
|---|---|
| AscI/BsiWI (730-1) | 722 bp 5' portion of *Yarrowia* Lip2 gene (labeled as "Lip2.5N" in Figure; GenBank Accession No. AJ012632) |
| PacI/SphI (4141-3438) | 697 bp 3' portion of *Yarrowia* Lip2 gene (labeled as "Lip2.3N" in Figure; GenBank Accession No. AJ012632) |
| SwaI/BsiWI (13382-1) | YAT1::YlCPT1::Aco, comprising: YAT1: *Yarrowia lipolytica* YAT1 promoter (labeled as "YAT" in Figure; Patent Publication US 2006/0094102-A1); YlCPT1: *Yarrowia lipolytica* diacylglycerol cholinephosphotransferase gene (SEQ ID NO: 68) (labeled as "CPT1" in Figure; PCT Publication No. WO 2006/052870); Aco: Aco terminator sequence from *Yarrowia* Aco gene (GenBank Accession No. AJ001300) |
| PmeI/SwaI (10745-13382) | FBAIN::EgD8M::Lip1 comprising: FBAIN: *Yarrowia lipolytica* FBAIN promoter (U.S. Pat. No. 7,202,356); EgD8M: Synthetic mutant Δ8 desaturase (SEQ ID NO: 22) (labeled as "D8S-23" in Figure; Patent Publication US 2008-0138868 A1), derived from *Euglena gracilis* ("EgD8S"; U.S. Pat. No. 7,256,033); Lip1: Lip1 terminator sequence from *Yarrowia* Lip1 gene (GenBank Accession No. Z50020) |
| PmeI/ClaI (10745-8650) | GPD::EgD9eS::Lip2, comprising: GPD: *Yarrowia lipolytica* GPD promoter (labeled as "GPD Pro" in Figure; U.S. Pat. No. 7,259,255); EgD9eS: codon-optimized D9 elongase gene (SEQ ID NO: 6), derived from *Euglena gracilis* (labeled as "EgD9ES" in Figure; PCT Publication No. WO 2007/061742); Lip2: Lip2 terminator sequence from *Yarrowia* Lip2 gene (GenBank Accession No. AJ012632) |
| ClaI/EcoRI (8650-6581) | *Yarrowia* Ura3 gene (GenBank Accession No. AJ306421) |
| EcoRI/PacI (6581-4141) | YAT1::EgD5S::ACO, comprising: YAT1: *Yarrowia lipolytica* YAT1 promoter (labeled as "YAT" in Figure; Patent Publication US 2006/0094102-A1); EgD5S: codon-optimized Δ5 desaturase (SEQ ID NO: 36), derived from *Euglena gracilis* (PCT Publication No. WO 2007/136671); Aco: Aco terminator sequence from *Yarrowia* Aco gene (GenBank Accession No. AJ001300) |

The pZKL2-5U89GC plasmid was digested with AscI/SphI, and then used for transformation of strain Y4128U3 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and FAMEs were prepared by trans-esterification, and subsequently analyzed with a Hewlett-Packard 6890 GC.

GC analyses showed that most of the selected 96 strains produced 32-39.9% EPA of total lipids. There were 6 strains (i.e., #35, #38, #40, #71, #76 and #81 of the second group) that produced about 41.1%, 41.8%, 41.7%, 41.1%, 41% and 41.1% EPA of total lipids. These six strains were designated as Y4215, Y4216, Y4217, Y4218, Y4219 and Y4220, respectively.

The final genotype of strain Y4215, Y4216, Y4217, Y4218, Y4219 and Y4220 with respect to wild type *Yarrowia lipolytica* ATCC #20362 was: YALI0C18711g−, Pex10−, YALI0F24167g−, unknown 1−, unknown 3−, GPD:: FmD12::Pex20, YAT1::FmD12::OCT, GPM/FBAIN:: FmD12S::OCT, YAT1::ME3S::Pex16, EXP1::ME3S:: Pex20, GPAT::EgD9e::Lip2, EXP1::EgD9eS::Lip1, FBAINm::EgD9eS::Lip2, FBA::EgD9eS::Pex20, GPD:: EgD9eS::Lip2, FBAINm::EgD8M::Pex20, FBAIN:: EgD8M::Lip1, EXP1::EgD8M::Pex16, GPDIN::EgD8M:: Lip1, YAT1::EgD8M::Aco, FBAIN::EgD5::Aco, EXP1:: EgD5S::Pex20, YAT1::EgD5S::Aco, YAT1::RD5S::OCT, YAT1::PaD17S::Lip1, EXP1::PaD17::Pex16, FBAINm:: PaD17::Aco, YAT1::YlCPT1::ACO.

Generation of Strain Y4217U2 (Ura−)

In order to disrupt the Ura3 gene in strain Y4217, construct pZKUE3S (FIG. 6B; SEQ ID NO:130) was used to integrate a chimeric EXP1::ME3S::Pex20 gene into the Ura3 gene of strain Y4217. Following transformation, cells were plated onto MM+5-FOA selection plates and maintained at 30° C. for 3 to 4 days.

A total of 6 transformants grown on MM+5-FOA plates were picked and re-streaked onto MM plates and MM+5-FOA plates, separately. All 6 strains had a Ura− phenotype (i.e., cells could grow on MM+5-FOA plates, but not on MM plates). The cells were scraped from the MM+5-FOA plates, lipids were extracted, and FAMEs were prepared by transesterification, and subsequently analyzed with a Hewlett-Packard 6890 GC.

GC analyses showed the presence of 18.7% to 28.6% EPA of total lipids in all of the transformants with pZKUE3S grown on MM+5-FOA plates. Two strains (i.e., #4 and #5) that produced 22.5% and 28.6% EPA of total lipids were designated as strains Y4217U1 and Y4217U2, respectively.

Generation of Y4259 Strain to Produce about 46.5% EPA of Total Lipids

Construct pZKL1-2SP98C (FIG. 7B; SEQ ID NO:132) was generated to integrate one Δ9 elongase gene, one Δ8 desaturase gene, one Δ12 desaturase gene and one *Yarrowia lipolytica* diacylglycerol cholinephosphotransferase gene (CPT1) into the Lip1 loci (GenBank Accession No. Z50020) of strain Y4217U2 to thereby enable higher level production of EPA. The pZKL1-2SP98C plasmid contained the following components:

TABLE 14

Description of Plasmid pZKL1-2SP98C (SEQ ID NO: 132)

| RE Sites And Nucleotides Within SEQ ID NO: 132 | Description Of Fragment And Chimeric Gene Components |
|---|---|
| AscI/BsiWI (3474-2658) | 809 bp 5' portion of *Yarrowia* Lip1 gene (labeled as "Lip1-5'N" in Figure; GenBank Accession No. Z50020) |
| PacI/SphI (6951-6182) | 763 bp 3' portion of *Yarrowia* Lip1 gene (labeled as "Lip1.3N" in Figure; GenBank Accession No. Z50020) |
| SwaI/BsiWI (1-2658) | GPD::YlCPT1::Aco, comprising: GPD: *Yarrowia lipolytica* GPD promoter (U.S. Pat. No. 7,259,255); YlCPT1: *Yarrowia lipolytica* diacylglycerol cholinephosphotransferase gene (SEQ ID NO: 68) (labeled as "CPT1" in Figure; PCT Publication No. WO 2006/052870); Aco: Aco terminator sequence from *Yarrowia* Aco gene (GenBank Accession No. AJ001300) |
| PmeI/SwaI (13241-1) | FBAIN::EgD8M::Lip1 comprising: FBAIN: *Yarrowia lipolytica* FBAIN promoter (U.S. Pat. No. 7,202,356); EgD8M: Synthetic mutant Δ8 desaturase (SEQ ID NO: 22; Patent Publication US 2008-0138868 A1), derived from *Euglena gracilis* ("EgD8S"; U.S. Pat. No. 7,256,033); Lip1: Lip1 terminator sequence from *Yarrowia* Lip1 gene (GenBank Accession No. Z50020) |
| PmeI/ClaI (13241-11385) | YAT1::EgD9eS::Lip2, comprising: YAT1: *Yarrowia lipolytica* YAT1 promoter (labeled as "YAT" in Figure; Patent Publication US 2006/0094102-A1); EgD9eS: codon-optimized Δ9 elongase gene (SEQ ID NO: 6), derived from *Euglena gracilis* (labeled as "EgD9ES" in Figure; PCT Publication No. WO 2007/061742); Lip2: Lip2 terminator sequence from *Yarrowia* Lip2 gene (GenBank Accession No. AJ012632) |
| ClaI/EcoRI (11385-9648) | LoxP::Ura3::LoxP, comprising: LoxP sequence (SEQ ID NO: 123); *Yarrowia* Ura3 gene (GenBank Accession No. AJ306421); LoxP sequence (SEQ ID NO: 123) |
| EcoRI/PacI (9648-6951) | EXP1::FmD12S::ACO, comprising: EXP1: *Yarrowia lipolytica* export protein (EXP1) promoter (labeled as "Exp" in Figure; PCT Publication No. WO 2006/052870); FmD12S: codon-optimized Δ12 elongase (SEQ ID NO: 56), derived from *Fusarium moniliforme* (labeled as "FD12S" in Figure; PCT Publication No. WO 2005/047485); Aco: Aco terminator sequence from *Yarrowia* Aco gene (GenBank Accession No. AJ001300) |

The pZKL1-2SP98C plasmid was digested with AscI/SphI, and then used for transformation of strain Y4217U2 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and FAMEs were prepared by trans-esterification, and subsequently analyzed with a Hewlett-Packard 6890 GC.

GC analyses showed that most of the selected 72 strains produced 40-44% EPA of total lipids. There were 6 strains (i.e., #2, #4, #8, #9, #48 and #58) that produced about 46.5%, 44.5%, 44.5%, 44.8%, 44.5% and 44.3% EPA of total lipids. These six strains were designated as Y4259, Y4260, Y4261, Y4262, Y4263 and Y4264, respectively.

The final genotype of strain Y4259 with respect to wild type *Yarrowia lipolytica* ATCC #20362 was: YALI0C18711g–, Pex10–, YALI0F24167g–, unknown 1–, unknown 3–, unknown 8–, GPD::FmD12::Pex20, YAT1::FmD12::OCT, GPM/FBAIN::FmD12S::OCT, EXP1::FmD12S::Aco, YAT1::ME3S::Pex16, EXP1::ME3S::Pex20 (2 copies), GPAT::EgD9e::Lip2, EXP1::EgD9eS::Lip1, FBAINm::EgD9eS::Lip2, FBA::EgD9eS::Pex20, GPD::EgD9eS::Lip2, YAT1::EgD9eS::Lip2, FBAINm::EgD8M::Pex20, FBAIN::EgD8M::Lip1 (2 copies), EXP1::EgD8M::Pex16, GPDIN::EgD8M::Lip1, YAT1::EgD8M::Aco, FBAIN::EgD5::Aco, EXP1::EgD5S::Pex20, YAT1::EgD5S::Aco, YAT1::RD5S::OCT, YAT1::PaD17S::Lip1, EXP1::PaD17::Pex16, FBAINm::PaD17::Aco, YAT1::YlCPT1::ACO, GPD::YlCPT1::ACO.

Generation of Strain Y4259U2 (Ura–)

Figure 8B:
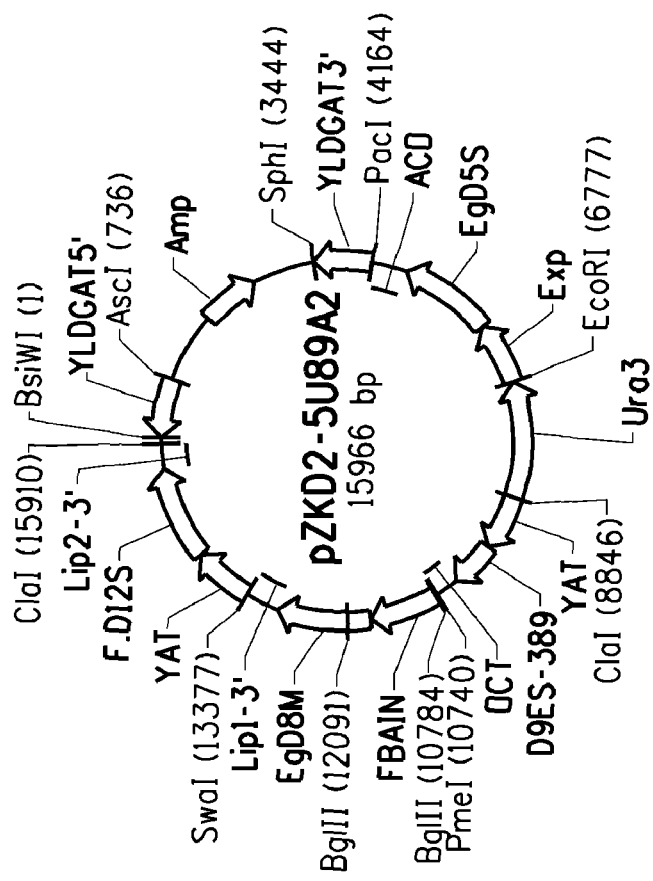
Figure 8A:
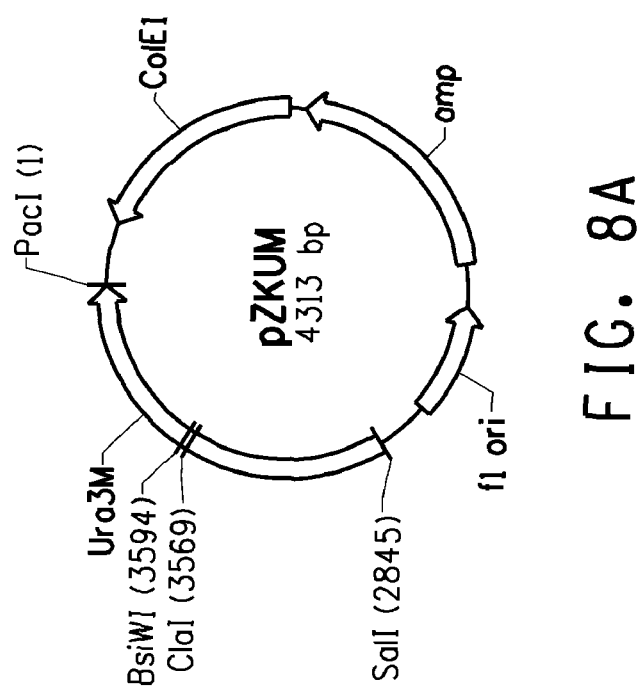

In order to disrupt the Ura3 gene in Y4259 strain, construct PZKUM (FIG. 8A; SEQ ID NO:133) was used to integrate a Ura3 mutant gene into the Ura3 gene of strain Y4259. The plasmid PZKUM contained the following components:

TABLE 15

Description of Plasmid pZKUM (SEQ ID NO: 133)

| RE Sites And Nucleotides Within SEQ ID NO: 133 | Description Of Fragment And Chimeric Gene Components |
|---|---|
| SalI/PacI (32845-1) | Synthetic mutant Ura3 gene (SEQ ID NO: 134, wherein the 1459 bp DNA fragment contains a 33 bp deletion from +21 to +53, a 1 bp deletion at +376 and a 3 bp deletion from +400 to +403 of the *Yarrowia* Ura3 coding region (GenBank Accession No. AJ306421)) |
| 1112-232 | ColE1 plasmid origin of replication |
| 2042-1182 | Ampicillin-resistance gene ($Amp^R$) for selection in *E. coli* |

A total of 3 transformants grown on MM+5-FOA plates were picked and re-streaked onto MM plates and MM+5-FOA plates, separately. All 3 strains had a Ura– phenotype (i.e., cells could grow on MM+5-FOA plates, but not on MM plates). The cells were scraped from the MM+5-FOA plates, lipids were extracted, and FAMEs were prepared by trans-esterification, and subsequently analyzed with a Hewlett-Packard 6890 GC.

GC analyses showed the presence of 31.4%, 31% and 31.3% EPA of total lipids in the #1, #2 and #3 transformants with PZKUM grown on MM+5-FOA plates. These three strains were designated as strains Y4259U1, Y4259U2 and Y4259U3, respectively (collectively, Y4259U).

Generation of Y4305 Strain to Produce Greater than 53% EPA of Total Lipids

Construct pZKD2-5U89A2 (FIG. 8B; SEQ ID NO:135) was generated to integrate one Δ9 elongase gene, one Δ5 desaturase gene, one Δ8 desaturase gene and one Δ12 desaturase gene into the diacylglycerol acyltransferase (DGAT2) loci of strain Y4259U2, to thereby enable higher level production of EPA. The pZKD2-5U89A2 plasmid contained the following components:

TABLE 16

Description of Plasmid pZKD2-5U89A2 (SEQ ID NO: 135)

| RE Sites And Nucleotides Within SEQ ID NO: 135 | Description Of Fragment And Chimeric Gene Components |
|---|---|
| AscI/BsiWI (1-736) | 728 bp 5' portion of *Yarrowia* DGAT2 gene (SEQ ID NO: 93) (labeled as "YLDGAT5" in Figure; U.S. Pat. No. 7,267,976) |
| PacI/SphI (4164-3444) | 714 bp 3' portion of *Yarrowia* DGAT2 gene (SEQ ID NO: 93) (labeled as "YLDGAT3" in Figure; U.S. Pat. No. 7,267,976) |
| SwaI/BsiWI (13377-1) | YAT1::FmD12S::Lip2, comprising:<br>YAT1: *Yarrowia lipolytica* YAT1 promoter (labeled as "YAT" in Figure; Patent Publication US 2006/0094102-A1);<br>FmD12S: codon-optimized Δ12 elongase (SEQ ID NO: 56), derived from *Fusarium moniliforme* (labeled as "F.D12S" in Figure; PCT Publication No. WO 2005/047485);<br>Lip2: Lip2 terminator sequence from *Yarrowia* Lip2 gene (GenBank Accession No. AJ012632) |
| PmeI/SwaI (10740-13377) | FBAIN::EgD8M::Lip1 comprising:<br>FBAIN: *Yarrowia lipolytica* FBAIN promoter (U.S. Pat. No. 7,202,356);<br>EgD8M: Synthetic mutant Δ8 desaturase (SEQ ID NO: 22; Patent Publication US 2008-0138868 A1), derived from *Euglena gracilis* ("EgD8S"; U.S. Pat. No. 7,256,033);<br>Lip1: Lip1 terminator sequence from *Yarrowia* Lip1 gene (GenBank Accession No. Z50020) |
| ClaI/PmeI (8846-10740) | YAT1::E389D9eS::OCT, comprising:<br>YAT1: *Yarrowia lipolytica* YAT1 promoter (labeled as "YAT" in Figure; Patent Publication US 2006/0094102-A1);<br>E389D9eS: codon-optimized Δ9 elongase (SEQ ID NO: 10), derived from *Eutreptiella* sp. CCMP389 (labeled as "D9ES-389" in Figure; PCT Publication No. WO 2007/061742);<br>OCT: OCT terminator sequence from *Yarrowia* OCT gene (GenBank Accession No. X69988) |
| ClaI/EcoRI (8846-6777) | *Yarrowia* Ura3 gene (GenBank Accession No. AJ306421) |
| EcoRI/PacI (6777-4164) | EXP1::EgD5S::ACO, comprising:<br>EXP1: *Yarrowia lipolytica* export protein (EXP1) promoter (labeled as "Exp" in Figure; PCT Publication No. WO 2006/052870);<br>EgD5S: codon-optimized Δ5 desaturase (SEQ ID NO: 36), derived from *Euglena gracilis* (PCT Publication No. WO 2007/136671);<br>Aco: Aco terminator sequence from *Yarrowia* Aco gene (GenBank Accession No. AJ001300) |

The pZKD2-5U89A2 plasmid was digested with AscI/SphI, and then used for transformation of strain Y4259U2 according to the General Methods. The transformant cells were plated onto MM plates and maintained at 30° C. for 3 to 4 days. Single colonies were re-streaked onto MM plates, and then inoculated into liquid MM at 30° C. and shaken at 250 rpm/min for 2 days. The cells were collected by centrifugation, resuspended in HGM and then shaken at 250 rpm/min for 5 days. The cells were collected by centrifugation, lipids were extracted, and FAMEs were prepared by trans-esterification, and subsequently analyzed with a Hewlett-Packard 6890 GC.

GC analyses showed that most of the selected 96 strains produced 40-46% EPA of total lipids. There were 4 strains (i.e., #12, #44, #56 and #93) that produced about 53.2%, 46.4%, 46.8% and 47.8% EPA of total lipids, respectively. These four strains were designated as Y4305, Y4306, Y4307 and Y4308, respectively.

The final genotype of strain Y4305 with respect to wild type *Yarrowia lipolytica* ATCC #20362 was SCP2− (YALI0E01298g), YALI0C18711g−, Pex10−, YALI0F24167g−, unknown 1−, unknown 3−, unknown 8−, GPD::FmD12::Pex20, YAT1::FmD12::OCT, GPM/FBAIN:: FmD12S::OCT, EXP1::FmD12S::Aco, YAT1::FmD12S:: Lip2, YAT1::ME3S::Pex16, EXP1::ME3S::Pex20 (3 copies), GPAT::EgD9e::Lip2, EXP1::EgD9eS::Lip1, FBAINm:: EgD9eS::Lip2, FBA::EgD9eS::Pex20, GPD::EgD9eS::Lip2, YAT1::EgD9eS::Lip2, YAT1::E389D9eS::OCT, FBAINm:: EgD8M::Pex20, FBAIN::EgD8M::Lip1 (2 copies), EXP1:: EgD8M::Pex16, GPDIN::EgD8M::Lip1, YAT1::EgD8M:: Aco, FBAIN::EgD5::Aco, EXP1::EgD5S::Pex20, YAT1:: EgD5S::Aco, EXP1::EgD5S::ACO, YAT1::RD5S::OCT, YAT1::PaD17S::Lip1, EXP1::PaD17::Pex16, FBAINm:: PaD17::Aco, YAT1::YlCPT1::ACO, GPD::YlCPT1::ACO.

Example 4

Determination of Total Lipid Content of *Yarrowia lipolytica* Strain Y4128

The total amount of lipid produced by strain Y4128 and the percentage of each fatty acid species in the lipid were measured by GC analysis. Specifically, total lipids were extracted, and FAMEs were prepared by trans-esterification, and subsequently analyzed with a Hewlett-Packard 6890 GC, as described in the General Methods.

Dry cell weight was determined by collecting cells from 10 mL of culture via centrifugation, washing the cells with water once to remove residual medium, drying the cells in a vacuum oven at 80° C. overnight, and weighing the dried cells. The total amount of FAMEs in a sample was determined by comparing the areas of all peaks in the GC profile with the peak area of an added known amount of internal standard C15:0 fatty acid.

Based on the above analyses, lipid content as a percentage of dry cell weight (DCW) and lipid composition was determined for strains Y4086 and Y4128. Strain Y4128 had decreased lipid content with respect to strain Y4086 (11.2 TFAs % DCW versus 28.6 TFAs % DCW). In contrast, strain Y4128 had elevated EPA concentrations among lipids with respect to strain Y4086, as shown below in Table 17. Fatty acids are identified as 18:0 (stearic acid), 18:1 (oleic acid), LA, ALA, EDA, DGLA, ETrA, ETA and EPA; fatty acid compositions were expressed as the weight percent (wt. %) of total fatty acids (TFAs).

TABLE 17

Lipid Composition In *Yarrowia lipolytica* Strains Y4086 And Y4128

| Sample | 18:0 | 18:1 | 18:2 [LA] | 18:3 (n-3) [ALA] | 20:2 [EDA] | 20:3 (n-6) [DGLA] | 20:3 (n-3) [ETrA] | 20:4 (n-3) [ETA] | 20:5 (n-3) [EPA] |
|---|---|---|---|---|---|---|---|---|---|
| Y4086 | 4.6 | 26.8 | 28.0 | 6.9 | 7.6 | 0.9 | 4.9 | 2.0 | 9.8 |
| Y4128 | 1.8 | 6.7 | 19.6 | 1.8 | 4.2 | 3.4 | 1.5 | 6.0 | 42.8 |

EPA content in the cell, expressed as mg EPA/g dry cell and calculated according to the following formula: (% of EPA/Lipid)*(% of Lipid/dry cell weight)*0.1, increased from 28 mg EPA/g DCW in strain Y4086 to 47.9 mg EPA/g DCW in strain Y4128.

Thus, the results in Table 17 showed that compared to the parent strain Y4086, strain Y4128 had a lower total lipid content (TFAs % DCW) (11.2% versus 28.6%), higher EPA % TFAs (42.8% versus 9.8%), and higher EPA % DCW (4.8% versus 2.8%). Additionally, strain Y4128 had a 3.3-fold increase in the amount of EPA relative to the total PUFAs (54% of the PUFAs [as a % TFAs] versus 16.3% of the PUFAs [as a % TFAs]) and a 1.7-fold increase in the amount of C20 PUFAs relative to the total PUFAs (73% of the PUFAs [as a % TFAs] versus 42% of the PUFAs [as a % TFAs]).

Example 5

Determination of the Integration Site of pZP2-2988 in *Yarrowia lipolytica* Strain Y4128 as a Pex10 Integration The genomic integration site of pZP2-2988 in strain Y4128 was determined by genome walking using the Universal GenomeWalker™ Kit from Clontech (Palo Alto, Calif.) following the manufacturer's recommended protocol. Based on the sequence of the plasmid, the following primers were designed for genome walking: pZP-GW-5-1 (SEQ ID NO:136), pZP-GW-5-2 (SEQ ID NO:137), pZP-GW-5-3 (SEQ ID NO:138), pZP-GW-5-4 (SEQ ID NO:139), pZP-GW-3-1 (SEQ ID NO:140), pZP-GW-3-2 (SEQ ID NO:141), pZP-GW-3-3 (SEQ ID NO:142) and pZP-GW-3-4 (SEQ ID NO:143).

Genomic DNA was prepared from strain Y4128 using the Qiagen Miniprep kit with a modified protocol. Cells were scraped off a YPD medium plate into a 1.5 mL microfuge tube. Cell pellet (100 µl) was resuspended with 250 µl of buffer P1 containing 0.125 M β-mercaptoethanol and 1 mg/mL zymolyase 20T (MP Biomedicals, Inc., Solon, Ohio). The cell suspension was incubated at 37° C. for 30 min. Buffer P2 (250 µl) was then added to the tube. After mixing by inverting the tube for several times, 350 µl of buffer N3 was added. The mixture was then centrifuged at 14,000 rpm for 5 min in a microfuge. Supernatant was poured into a Qiagen miniprep spin column, and centrifuged for 1 min. The column was washed once by adding 0.75 mL of buffer PE, followed by centrifugation at 14,000 rpm for 1 min. The column was dried by further centrifugation at 14,000 rpm for 1 min. Genomic DNA was eluted by adding 50 µl of buffer EB to the column, allowed to sit for 1 min and centrifuged at 14,000 rpm for 1 min.

Purified genomic DNA was used for genome walking. The DNA was digested with restriction enzymes DraI, EcoRV, PvuII and StuI separately, according to the protocol of the GenomeWalker kit. For each digestion, the reaction mixture contained 10 µl of 10× restriction buffer, 10 µl of the appropriate restriction enzyme and 8 µg of genomic DNA in a total volume of 100 µl. The reaction mixtures were incubated at 37° C. for 4 hrs. The digested DNA samples were then purified using a Qiagen PCR purification kit following the manufacturer's protocol exactly. DNA samples were eluted in 16 µl water. Purified, digested genomic DNA samples were then ligated to the Genome Walker adaptor (infra). Each ligation mixture contained 1.9 µl of the genome walker adaptor, 1.6 µl of 10× ligation buffer, 0.5 µl T4 DNA ligase and 4 µl of the digested DNA. The reaction mixtures were incubated at 16° C. overnight. Then, 72 µl of 50 mM Tris HCl, 1 mM EDTA, pH 7.5 were added to each ligation mixture.

For 5'-end genome walking, four PCR reactions were carried out using 1 µl of each ligation mixture individually as template. In addition, each reaction mixture contained 1 µl of 10 µM primer pZP-GW-5-1 (SEQ ID NO:136), 1 µl of 10 µM kit-supplied Genome Walker adaptor, 41 µl water, 5 µl 10× cDNA PCR reaction buffer and 1 µl Advantage cDNA polymerase mix from Clontech. The sequence of the Genome Walker adaptor (SEQ ID NOs:144 [top strand] and 145 [bottom strand]), is shown below:

5'-GTAATACGACTCACTATAGGGCACGCGTGGTCGACGGCCCGGGCTGG

T-3'

3'-H2N-CCCGACCA-5'

The PCR conditions were as follows: 95° C. for 1 min, followed by 30 cycles at 95° C. for 20 sec and 68° C. for 3 min, followed by a final extension at 68° C. for 7 min. The PCR products were each diluted 1:100 and 1 µl of the diluted PCR product used as template for a second round of PCR. The conditions were exactly the same except that pZP-GW-5-2 (SEQ ID NO:137) replaced pZP-GW-5-1 (SEQ ID NO:136).

For 3'-end genome walking, four PCR reactions were carried out as above, except primer pZP-GW-3-1 (SEQ ID NO:140) and nested adaptor primer (SEQ ID NO:146) were used. The PCR products were similarly diluted and used as template for a second round of PCR, using PZP-GW-3-2 (SEQ ID NO:141) to replace pZP-GW-3-1 (SEQ ID NO:140).

PCR products were analyzed by gel electrophoresis. One reaction product, using EcoRV digested genomic DNA as template and the primers pZP-GW-3-2 and nested adaptor primer, generated a ~1.6 kB fragment. This fragment was isolated, purified with a Qiagen gel purification kit and cloned into pCR2.1-TOPO. Sequence analysis showed that the fragment included a portion of plasmid pZP2-2988 and the *Yarrowia* genomic DNA from chromosome C. The junction between them was at nucleotide position 139826 of chromosome C. This was inside the coding region of the Pex10 gene (Gen Bank Accession No. CAG81606).

To determine the 5' end of the junction, PCR amplification was performed using genomic DNA from strain Y4128 as the template and primers Per10 F1 (SEQ ID NO:147) and ZPGW-5-5 (SEQ ID NO:148). The reaction mixture included 1 µl each of 20 µM primer, 1 µl genomic DNA, 22 µl water and 25 µl TaKaRa ExTaq 2× premix (TaKaRa Bio Inc., Otsu Shiga, Japan). The thermocycler conditions were: 94° C. for 1 min, followed by 30 cycles of 94° C. for 20 sec, 55° C. for 20 sec and 72° C. for 2 min, followed by a final extension at 72° C. for 7 min. A 1.6 kB DNA fragment was amplified and cloned into pCR2.1-TOPO. Sequence analysis showed that it was a chimeric fragment between *Yarrowia* genomic DNA from chromosome C and pZP2-2988. The junction was at nucleotide position 139817 of chromosome C. Thus, a 10 nucleotide segment of chromosome C was replaced by the AscI/SphI fragment from pZP2-2988 (FIG. 6A) in strain Y4128. As a result, Pex10 in strain Y4128 was lacking the last 32 amino acids of the encoded protein (SEQ ID NO:120).

Based on the above conclusions, the Y4128U strains isolated in Example 3 (supra) will be referred to subsequently as Δpex10 strains. For clarity, strain Y4128U1 is equivalent to strain Y4128U1 (Δpex10).

Example 6

Plasmid Expression of Pex10 in *Yarrowia lipolytica* Strain Y4128U1 (Δpex10)

Three plasmids that carried the *Y. lipolytica* Pex10 gene were constructed: 1) pFBAIn-PEX10 allowed the expression of the Pex10 ORF under the control of the FBAINm promoter; and, 2) pPEX10-1 and pPEX10-2 allowed the expression of Pex10 under control of the native Pex10 promoter, although pPEX10-1 used a shorter version (~500 bp) while pPEX10-2 used a longer version (~900 bp) of the promoter. Following construction of these expression plasmids and transformation, the effect of Pex10 plasmid expression on total oil and EPA level in the *Y. lipolytica* strain Y4128U1 (Δpex10) was determined. Deletion of Pex10 resulted in an increased amount of EPA as a percent of TFAs, but a reduced amount of total lipid, as a percent of DCW, in the cell.

Construction of pFBAIn-PEX10, pPEX10-1 and pPEX10-2

To construct pFBAIn-PEX10, the primers Per10 F1 (SEQ ID NO:147) and Per10 R (SEQ ID NO:149) were used to amplify the coding region of the Pex10 gene using *Y. lipolytica* genomic DNA as template. The PCR reaction mixture contained 1 µl each of 20 µM primers, 1 µl of *Y. lipolytica* genomic DNA (~100 ng), 25 µl ExTaq 2× premix and 22 µl water. The reaction was carried out as follows: 94° C. for 1 min, followed by 30 cycles of 94° C. for 20 sec, 55° C. for 20 sec and 72° C. for 90 sec, followed by a final extension of 72° C. for 7 min. The PCR product, a 1168 bp DNA fragment, was purified with a Qiagen PCR purification kit, digested with NcoI and NotI, and cloned into pFBAIn-MOD-1 (SEQ ID NO:150; FIG. 9A) digested with the same two restriction enzymes.

Of the 8 individual clones subjected to sequence analysis, 2 had the correct sequence of Pex10 with no errors. The components of pFBAIn-PEX10 (SEQ ID NO:151; FIG. 9B) are listed below in Table 18.

TABLE 18

Components Of Plasmid pFBAIn-PEX10 (SEQ ID NO: 151)

| RE Sites And Nucleotides Within SEQ ID NO: 151 | Description Of Fragment And Chimeric Gene Components |
|---|---|
| BglII-BsiWI (6040-318) | FBAINm::Pex10::Pex20, comprising: FBAINm: *Yarrowia lipolytica* FBAINm promoter (U.S. Pat. No. 7,202,356); Pex10: *Y. lipolytica* Pex10 ORF (GenBank Accession No. AB036770, nucleotides 1038-2171; SEQ ID NO: 104); Pex20: Pex20 terminator sequence from *Yarrowia* Pex20 gene (GenBank Accession No. AF054613) |
| PacI-BglII (4530-6040) | *Yarrowia* Ura3 (GenBank Accession No. AJ306421) |
| (3123-4487) | *Yarrowia* autonomous replicating sequence 18 (ARS18; GenBank Accession No. A17608) |
| (2464-2864) | *E. coli* f1 origin of replication |
| (1424-2284) | Ampicillin-resistance gene ($Amp^R$) for selection in *E. coli* |
| (474-1354) | ColE1 plasmid origin of replication |

Figures 10A, 10B:
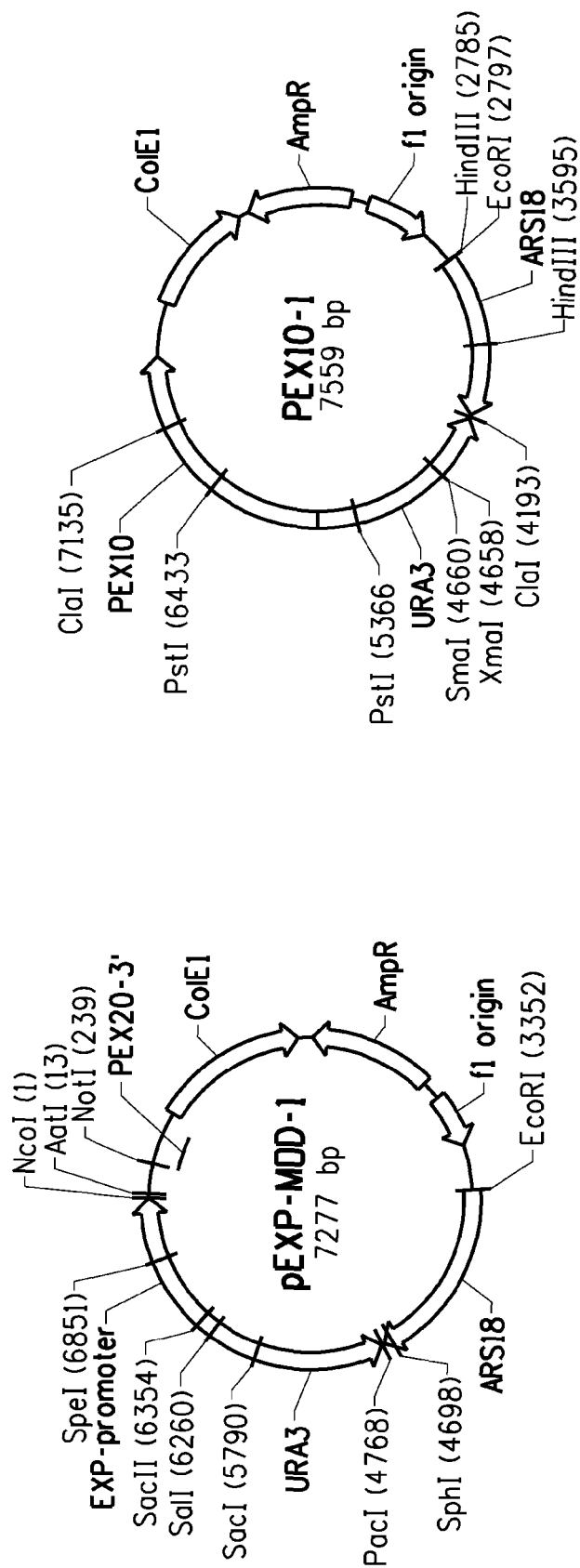

To construct pPEX10-1 and pPEX10-2, primers PEX10-R-BsiWI (SEQ ID NO:152), PEX10-F1-SalI (SEQ ID NO:153) and PEX10-F2-SalI (SEQ ID NO:154) were designed and synthesized. PCR amplification using genomic *Yarrowia lipolytica* DNA and primers PEX10-R-BsiWI and PEX10-F1-SalI generated a 1873 bp fragment containing the Pex10 ORF, 500 bp of the 5' upstream region and 215 bp of the 3' downstream region of the Pex10 gene, flanked by SalI and BsiWI restriction sites at either end. This fragment was purified with the Qiagen PCR purification kit, digested with SalI and BsiWI, and cloned into pEXP-MOD-1 (SEQ ID NO:155; FIG. 10A) digested with the same two enzymes to generate pPEX10-1 (SEQ ID NO:156; FIG. 12B). Plasmid pEXP-MOD1 is similar to pFBAIn-MOD-1 (SEQ ID NO:150; FIG. 9A) except that the FBAINm promoter in the latter was replaced with the EXP1 promoter. Table 19 lists the components of pPEX10-1.

TABLE 19

Components Of Plasmid pPEX10-1 (SEQ ID NO: 156)

| RE Sites And Nucleotides Within SEQ ID NO: 156 | Description Of Fragment And Chimeric Gene Components |
|---|---|
| SalI-BsiWI (5705-1) | Pex10-5'::Pex10::Pex10-3', comprising: Pex10-5': 500 bp of the 5' promoter region of *Yarrowia lipolytica* Pex10 gene (GenBank Accession No. AB036770); Pex10: *Yarrowia lipolytica* Pex10 ORF (GenBank Accession No. AB036770, nucleotides 1038-2171; SEQ ID NO: 104); Pex10-3': 215 bp of Pex10 terminator sequence from *Yarrowia* Pex10 gene (GenBank Accession No. AB036770) [Note the entire Pex10-5'::Pex10::Pex10-3' expression cassette is labeled collectively as "PEX10" in the Figure] |
| PacI-SalI (4216-5703) | *Yarrowia* Ura3 gene (GenBank Accession No. AJ306421) |
| (2806-4170) | *Yarrowia* autonomous replicating sequence 18 (ARS18; GenBank Accession No. M91600) (GenBank Accession No. A17608) |
| (2147-2547) | *E. coli* f1 origin of replication |
| (1107-1967) | Ampicillin-resistance gene ($Amp^R$) for selection in *E. coli* |
| (157-1037) | ColE1 plasmid origin of replication |

PCR amplification of *Yarrowia lipolytica* genomic DNA using PEX10-R-BsiWI (SEQ ID NO:152) and PEX10-F2-SalI (SEQ ID NO:154) generated a 2365 bp fragment containing the PEX10 ORF, 991 bp of the 5' upstream region and 215 bp of the 3' downstream region of the Pex10 gene, flanked by SalI and BsiWI restriction sites at either end. This fragment was purified with a Qiagen PCR purification kit, digested with SalI and BsiWI, and cloned into similarly digested pEXP-MOD-1. This resulted in synthesis of pPEX10-2 (SEQ ID NO:157), whose construction is analogous to that of plasmid pPEX10-1 (Table 19, supra), with the exception of the longer Pex10-5' promoter in the chimeric Pex10-5'::Pex10::Pex10-3' gene.

Expression of Pex10 in Strain Y4128U1 (Δpex10)

Plasmids pFBAIN-MOD-1 (control; SEQ ID NO:150), pFBAIn-PEX10 (SEQ ID NO:151), pPEX10-1 (SEQ ID NO:156) and pPEX10-2 (SEQ ID NO:157) were transformed into Y4128U1 (Δpex10) according to the protocol in the General Methods. Transformants were plated on MM plates. The total lipid content and fatty acid composition of transformants carrying the above plasmids were analyzed as described in Example 4.

Lipid content as a percentage of dry cell weight (TFAs % DCW) and lipid composition are shown below in Table 20. Specifically, fatty acids are identified as 18:0 (stearic acid), 18:1 (oleic acid), LA, ALA, EDA, DGLA, ETrA, ETA and EPA; fatty acid compositions were expressed as the weight percent (wt. %) of total fatty acids.

TABLE 20

Lipid Composition In *Yarrowia lipolytica* Strain Y4128U1 (Δpex10)
Transformed With Various Pex10 Plasmids

| Plasmid | TFAs % DCW | 18:0 | 18:1 | 18:2 [LA] | 18:3 (ω3) [ALA] | 20:2 [EDA] | 20:3 (ω6) [DGLA] | 20:3 (ω3) [ETrA] | 20:4 (ω3) [ETA] | 20:5 (ω3) [EPA] |
|---|---|---|---|---|---|---|---|---|---|---|
| pFBAIN-MOD-1 | 22.8 | 1.9 | 9.6 | 18.3 | 2.0 | 4.3 | 2.3 | 2.1 | 5.9 | 27.7 |
| pFBAIN-PEX10 | 29.2 | 4.0 | 24.9 | 25.1 | 7.6 | 6.6 | 1.0 | 5.3 | 3.6 | 10.8 |
| pPEX10-1 | 27.1 | 3.9 | 25.0 | 25.2 | 8.2 | 6.4 | 0.9 | 5.2 | 3.5 | 10.7 |
| pPEX10-2 | 28.5 | 4.3 | 25.4 | 24.5 | 7.6 | 6.4 | 1.0 | 5.3 | 3.4 | 10.8 |

The results in Table 20 showed that expression of Pex10 in Y4128U1 (Δpex10), either from the native *Y. lipolytica* Pex10 promoter or from the *Y. lipolytica* FBAINm promoter, reduced the percent of EPA back to the level of Y4086 while increasing the total lipid amount (TFA % DCW) up to the level of Y4086 (see data of Table 17 for comparison). EPA content per gram of dry cell changed from 63.2 mg in the case of the control sample (i.e., cells carrying pFBAIn-MOD-1) to 31.5 mg in cells carrying pFBAIn-PEX10, 29 mg in cells carrying pPEX10-1 and 30.8 mg in cells carrying pPEX10-2. These results demonstrated that disruption of the ring-finger domain of Pex10 increased the amount of EPA but reduced the amount of total lipid in the cell.

Thus, the results in Table 20 showed that compared to Y4128U1 (Δpex10) transformant with control plasmid, all transformants with Pex10 expressing plasmids showed higher lipid content (TFAs % DCW) (>27% versus 22.8%), lower EPA % TFAs (ca. 10.8% versus 27.7%), and lower EPA % DCW (<3.1% versus 6.3%). Additionally, strain Y4128U1 (Δpex10) transformant with control plasmid, as compared to those transformants with Pex10 expressing plasmids, had a 2.5-fold increase in the amount of EPA relative to the total PUFAs (44% of the PUFAs [as a % TFAs] versus 17.5% (avg) of the PUFAs [as a % TFAs]) and a 1.5-fold increase in the amount of C20 PUFAs relative to the total PUFAs (67% of the PUFAs [as a % TFAs] versus 44% (avg) of the PUFAs [as a % TFAs]).

Example 7

Generation of *Yarrowia lipolytica* Strain Y4184U to Produce EPA

*Y. lipolytica* strain Y4184U was used as the host in Example 8, infra. Strain Y4184U was derived from *Y. lipolytica* ATCC #20362, and is capable of producing high EPA relative to the total lipids via expression of a Δ9 elongase/Δ8 desaturase pathway. The strain has a Ura– phenotype and its construction is described in Example 7 of PCT Publication No. WO 2008/073367, hereby incorporated herein by reference.

In summary, however, the development of strain Y4184U required the construction of strain Y2224, strain Y4001, strain Y4001U, strain Y4036, strain Y4036U and strain Y4069 (supra, Example 1). Further development of strain Y4184U (diagrammed in FIG. 11B) required generation of strain Y4084, strain Y4084U1, strain Y4127 (deposited with the American Type Culture Collection on Nov. 29, 2007, under accession number ATCC PTA-8802), strain Y4127U2, strain Y4158, strain Y4158U1 and strain Y4184.

The final genotype of strain Y4184 (producing 31% EPA of total lipids) with respect to wildtype *Yarrowia lipolytica* ATCC #20362 was unknown 1–, unknown 2–, unknown 4–, unknown 5–, unknown 6–, unknown 7–, YAT1::ME3S:: Pex16, EXP1::ME3S::Pex20 (2 copies), GPAT::EgD9e:: Lip2, FBAINm::EgD9eS::Lip2, EXP1::EgD9eS::Lip1, FBA::EgD9eS::Pex20, YAT1::EgD9eS::Lip2, GPD:: EgD9eS::Lip2, GPDIN::EgD8M::Lip1, YAT1::EgD8M:: Aco, EXP1::EgD8M::Pex16, FBAINm::EgD8M::Pex20, FBAIN::EgD8M::Lip1 (2 copies), GPM/FBAIN::FmD12S:: Oct, EXP1::FmD12S::Aco, YAT1::FmD12::Oct, GPD:: FmD12::Pex20, EXP1::EgD5S::Pex20, YAT1::EgD5S::Aco, YAT1::Rd5S::Oct, FBAIN::EgD5::Aco, FBAINm::PaD17:: Aco, EXP1::PaD17::Pex16, YAT1::PaD17S::Lip1, YAT1:: YlCPT1::Aco, GPD::YlCPT1::Aco.

Finally, in order to disrupt the Ura3 gene in strain Y4184, construct pZKUE3S (FIG. 6B; SEQ ID NO:130) was used to integrate a EXP1::ME3S::Pex20 chimeric gene into the Ura3 gene of strain Y4184 to result in strains Y4184U1 (11.2% EPA of total lipids), Y4184U2 (10.6% EPA of total lipids) and Y4184U4 (15.5% EPA of total lipids), respectively (collectively, Y4184U).

Example 8

Chromosomal Deletion of Pex10 in *Yarrowia lipolytica* Strain Y4184U4 Increases Accumulation of EPA and Total Lipid Content Construct pYPS161 (FIG. 11B, SEQ ID NO:158) was used to knock out the chromosomal Pex10 gene from the EPA-producing *Yarrowia* strain Y4184U4 (Example 7). Transformation of *Y. lipolytica* strain Y4184U4 with the Pex10 knock-out construct resulted in creation of strain Y4184 (Δpex10). The effect of the Pex10 knockout on total oil and EPA level was determined and compared. Specifically, knockout of Pex10 resulted in an increased percentage of EPA (as % TFAs and % DCW) and an increased amount of total lipid in the cell.

Construct pYSP161

The construct pYPS161 contained the following components:

TABLE 21

Description of Plasmid pYPS161 (SEQ ID NO: 158)

| RE Sites And Nucleotides Within SEQ ID NO: 158 | Description Of Fragment And Chimeric Gene Components |
|---|---|
| AscI/BsiWI (1521-157) | 1364 bp Pex10 knockout fragment #1 of *Yarrowia* Pex10 gene (GenBank Accession No. AB036770) |
| PacI/SphI (5519-4229) | 1290 bp Pex10 knockout fragment #2 of *Yarrowia* Pex10 gene (GenBank Accession No. AB036770) |
| SalI/EcoRI (7170-5551) | *Yarrowia* Ura3 gene (GenBank Accession No. AJ306421) |
| 2451-1571 | ColE1 plasmid origin of replication |
| 3369-2509 | ampicillin-resistance gene (Amp$^R$) for selection in *E. coli* |
| 3977-3577 | *E. coli* f1 origin of replication |

Generation of Yarrowia lipolytica Knockout Strain Y4184 (ΔPex10)

Standard protocols, as described in the General Methods, were used to transform Yarrowia lipolytica strain Y4184U4 (Example 7) with the purified 5.3 kB AscI/SphI fragment of Pex10 knockout construct pYPS161 (supra), and a cells alone control was also prepared. There were ~200 to 250 colonies present for each of the experimental transformations, while there were no colonies present on the cells alone plates (per expectations).

Colony PCR was used to screen for cells having the Pex10 deletion. Specifically, the PCR reaction was performed using MasterAmp Taq polymerase (Epicentre Technologies, Madison, Wis.) following standard protocols, using PCR primers Pex-10del13'.Forward (SEQ ID NO:159) and Pex-10del2 5'.Reverse (SEQ ID NO:160). The PCR reaction conditions were 94° C. for 5 min, followed by 30 cycles at 94° C. for 30 sec, 60° C. for 30 sec and 72° C. for 2 min, followed by a final extension at 72° C. for 6 min. The reaction was then held at 4° C. If the Pex10 knockout construct integrated within the Pex10 region, a single PCR product 2.8 kB in size was expected to be produced. In contrast, if the strain integrated the Pex10 knockout construct in a chromosomal region other than the Pex10 region, then two PCR fragments, i.e., 2.8 kB and 1.1 kB, would be generated. Of the 288 colonies screened, the majority had the Pex10 knockout construct integrated at a random site. Only one of the 288 colonies contained the Pex10 knockout. This strain was designated Y4184 (Δpex10).

Evaluation of Yarrowia lipolytica Strains Y4184 and Y4184 (ΔPex10) for Total Oil and EPA Production To evaluate the effect of the Pex10 knockout on the percent of PUFAs in the total lipid fraction and the total lipid content in the cells, strains Y4184 and Y4184 (Δpex10) were grown under comparable oleaginous conditions. Specifically, cultures were grown at a starting $OD_{600}$ of ~0.1 in 25 mL of either fermentation media (FM) or FM medium without Yeast Extract (FM without YE) in a 250 mL flask for 48 hrs. The cells were harvested by centrifugation for 10 min at 8000 rpm in a 50 mL conical tube. The supernatant was discarded and the cells were re-suspended in 25 mL of HGM and transferred to a new 250 mL flask. The cells were incubated with aeration for an additional 120 hrs at 30° C.

To determine the dry cell weight (DCW), the cells from 5 mL of the FM-grown cultures and 10 mL of the FM without YE-grown cultures were processed. The cultured cells were centrifuged for 10 min at 4300 rpm. The pellet was re-suspended using 10 mL of saline and was centrifuged under the same conditions for a second time. The pellet was then re-suspended using 1 mL of sterile $H_2O$ (three times) and was transferred to a pre-weighed aluminum pan. The cells were dried overnight in a vacuum oven at 80° C. The weight of the cells was determined.

The total lipid content and fatty acid composition of transformants carrying the above plasmids were analyzed as described in Example 4.

DCW, total lipid content (TFAs % DCW), total EPA % TFAs, and EPA % DCW are shown below in Table 25.

TABLE 22

Lipid Composition In Y. lipolytica Strains Y4184 And Y4184 (ΔPex10)

| Media | Strain | DCW | TFAs % DCW | EPA % TFAs | EPA % DCW |
|---|---|---|---|---|---|
| FM | Y4184 | 11.5 | 11.8 | 20.6 | 2.4 |
|  | Y4184 (ΔPex10) | 11.5 | 17.6 | 43.2 | 7.6 |

TABLE 22-continued

Lipid Composition In Y. lipolytica Strains Y4184 And Y4184 (ΔPex10)

| Media | Strain | DCW | TFAs % DCW | EPA % TFAs | EPA % DCW |
|---|---|---|---|---|---|
| FM without YE | Y4184 | 4.6 | 8.8 | 23.2 | 2.0 |
|  | Y4184 (ΔPex10) | 4.0 | 13.2 | 46.1 | 6.1 |

The results in Table 22 showed that knockout of the chromosomal Pex10 gene in Y4184 (ΔPex10) increased the percent of EPA (as % TFAs and as % DCW) and increased the total oil content, as compared to the percent of EPA and total oil content in strain Y4184 whose native Pex10p had not been knocked out. More specifically, in FM media, there was about 109% increase in EPA (% TFAs), about 216% increase in EPA productivity (% DCW) and about 49% increase in total oil (TFAs % DCW). In FM without YE media, there was about 100% increase in EPA (% TFAs), about 205% increase in EPA productivity (% DCW) and about 50% increase in total oil (TFAs % DCW).

Thus, the results in Table 22 showed that in FM medium, compared to the parent strain Y4184, Y4184 (ΔPex10) strain had higher lipid content (TFAs % DCW) (17.6% versus 11.8%), higher EPA % TFAs (43.2% versus 20.6%), and higher EPA % DCW (7.6% versus 2.4%). Similarly, in FM medium without YE, compared to the parent strain Y4184, Y4184 (ΔPex10) strain had higher lipid content (TFAs % DCW) (13.2% versus 8.8%), higher EPA % TFAs (46.1% versus 23.2%), and higher EPA % DCW (6.1% versus 2.0%).

One of skill in the art could readily engineer a suitable knockout construct, similar to pYPS161, to result in knockout of an alternate chromosomal Pex gene upon transformation into the parental Y. lipolytica strain. Preferred Pex genes would include: Pex1p (GenBank Accession No. CAG82178; SEQ ID NO:95), Pex2p (GenBank Accession No. CAG77647; SEQ ID NO:96), Pex3p (GenBank Accession No. CAG78565; SEQ ID NO:97), Pex3Bp (GenBank Accession No. CAG83356; SEQ ID NO:98), Pex4p (GenBank Accession No. CAG79130; SEQ ID NO:99), Pex5p (GenBank Accession No. CAG78803; SEQ ID NO:100), Pex6p (GenBank Accession No. CAG82306; SEQ ID NO:101), Pex7p (GenBank Accession No. CAG78389; SEQ ID NO:102), Pex8p (GenBank Accession No. CAG80447; SEQ ID NO:103), Pex12p (GenBank Accession No. CAG81532; SEQ ID NO:105), Pex13p (GenBank Accession No. CAG81789; SEQ ID NO:106), Pex14p (GenBank Accession No. CAG79323; SEQ ID NO:107), Pex16p (GenBank Accession No. CAG79622; SEQ ID NO:108), Pex17p (GenBank Accession No. CAG84025; SEQ ID NO:109), Pex19p (GenBank Accession No. AAK84827; SEQ ID NO:110), Pex20p (GenBank Accession No. CAG79226; SEQ ID NO:111), Pex22p (GenBank Accession No. CAG77876; SEQ ID NO:112) and Pex26p (GenBank Accession No. NC_006072, antisense translation of nucleotides 117230-118387; SEQ ID NO:113).

It would be expected that the chromosomal disruption of Pex would result in an increased amount of PUFAs in total lipid fraction and in the oil fraction, as a percent of total fatty acids, as compared with a eukaryotic organism whose native peroxisome biogenesis factor protein has not been disrupted, wherein the amount of PUFAs can be: 1) the PUFA that is the desired end product of a functional PUFA biosynthetic pathway, as opposed to PUFA intermediates or by-products (e.g., EPA), 2) $C_{20}$ and $C_{22}$ PUFAs, and/or 3) total PUFAs. Preferred results not only achieve an increase in the amount of PUFAs as a percent of total fatty acids but also result in an increased amount of PUFAs as a percent of dry cell weight, as compared with a eukaryotic organism whose native peroxisome biogenesis factor protein has not been disrupted. Again, the amount of PUFAs can be: 1) the PUFA that is the desired end product of a functional PUFA biosynthetic pathway, as opposed to PUFA intermediates or by-products, 2) the $C_{20}$ and $C_{22}$ PUFAs, and/or 3) the total PUFAs. In some cases, the total lipid content will also increase, relative to that of a eukaryotic organism whose native peroxisome biogenesis factor protein has not been disrupted.

Example 9

Determination of the Integration Sites of pZKD2-5U89A2, pZP3-PA777U and pZKL2-5U89GC in *Yarrowia lipolytica* Strain Y4305

The genomic integration sites of pZKD2-5U89A2, pZP3-PA777U and pZKL2-5U89GC in *Yarrowia lipolytica* strain Y4305 were determined by genome walking using the Universal GenomeWalker™ Kit from Clontech, in a manner similar to that described in Example 5 for identification of the integration site of pZP2-2988 in *Yarrowia lipolytica* strain Y4128.

Genome Walking to Identify the pZKD2-5U89A2 Integration Site

Primers KL2-3-1 (SEQ ID NO:161) and KD2-3-2 (SEQ ID NO:162) were designed based on the pZKD2-5U89A2 sequence (SEQ ID NO:135), to identify the integration site of the 3'-end of the integration construct (i.e., the 3' flanking region of the *Yarrowia lipolytica* DGAT2 gene [SEQ ID NO:93]).

Genomic DNA was prepared from strain Y4305 using the Qiagen Miniprep kit with the modified protocol described in Example 5. Following isolation of genomic DNA, restriction enzyme digests with DraI, EcoRV, PvuII and StuI were prepared, according to the methodology of Example 5 and subsequently purified and ligated to the Genome Walker adaptor (SEQ ID NOs:144 and 145).

For genome walking, four PCR reactions were carried out using 1 µl of each ligation mixture individually as template. In addition, each reaction mixture contained 1 µl of 10 µM primer KL2-3-1 (SEQ ID NO:161), 1 µl of 10 µM adaptor primer from the kit (SEQ ID NOs:144 and 145), 41 µl water, 5 µl 10× cDNA PCR reaction buffer and 1 µl Advantage cDNA polymerase mix from Clontech. The PCR conditions were as follows: 95° C. for 1 min, followed by 30 cycles at 95° C. for 20 sec and 68° C. for 3 min, followed by a final extension at 68° C. for 7 min. The PCR products were each diluted 1:100 and 1 µl of the diluted PCR product was used as template for a second round of PCR. The conditions were exactly the same except that KD2-3-2 (SEQ ID NO:162) replaced KL2-3-1 (SEQ ID NO:161).

PCR products from the second round were analyzed by gel electrophoresis. One reaction product contained a ~560 bp fragment. This fragment was isolated, purified with a Qiagen gel purification kit and cloned into pCR2.1-TOPO (Invitrogen). Sequence analysis showed that the fragment included a portion of plasmid pZKD2-5U89A2 and a portion of *Y. lipolytica* genomic DNA from chromosome E. The junction between them was at nucleotide position 150905 of chromosome E. This was inside the coding region of the SCP2 gene (SEQ ID NO:87; GenBank Accession No. XM_503410).

To determine the 5' end of the junction, PCR amplification was performed using genomic DNA from strain Y4305 as the template and primers SCP-5-2 (SEQ ID NO:163) and KD2-5-3 (SEQ ID NO:164). The reaction mixture included 1 µl each of 20 µM primer, 1 µl genomic DNA, 22 µl water and 25 µl TaKaRa ExTaq 2× premix (Takara Bio. Inc., Shiga, Japan). The thermocycler conditions were: 94° C. for 1 min, followed by 30 cycles of 94° C. for 20 sec, 55° C. for 20 sec and 72° C. for 1 min, followed by a final extension at 72° C. for 7 min. A ~900 bp DNA fragment was amplified and cloned into pCR2.1-TOPO.

Sequence analysis revealed a 844 bp chimeric fragment (SEQ ID NO:173) that contained: 1) a portion of *Y. lipolytica* genomic DNA from chromosome E; 2) a stretch of unknown DNA that was 303 nucleotides in length (SEQ ID NO:174), having no homology to any known sequences in the NCBI database; and, 3) a 5' end of the AscI/SphI fragment from pZKD2-5U89A2 (SEQ ID NO:135). The junction was at nucleotide position 150901 of chromosome E. Thus, a three bp nucleotide segment of chromosome E was replaced by an unknown piece of DNA and the AscI/SphI fragment from pZD2-5U89A2 in strain Y4305. As a result, the SCP2 gene was interrupted after codon 71 of the 129 amino acid long protein. The resulting truncated SCP2 ORF lacks 58 codons at the C-terminus.

Genome Walking to Identify the pZP3-PA777U Integration Site

For pZP3-PA777U, the following primers were designed: 79-5-POX-1 (SEQ ID NO:165) and 79-5-POX-2 (SEQ ID NO:166). Genome walking for the 5'-insertion junction was performed using the same set of Y4305 genomic DNA ligation mixtures as described above in the case of pZKD2-5U89A2, using identical conditions, with the exception that: 1) primer 79-5-POX-1 replaced KL2-3-1 in the first round of PCR; and, 2) primer 79-POX-5-2 replaced KD2-3-2 in the second round of PCR. A ~2350 bp fragment was obtained from one of the PCR reactions (SEQ ID NO:175). This fragment was sequenced and shown to contain *Y. lipolytica* genomic DNA from chromosome F, a 1729 bp fragment of unknown DNA (SEQ ID NO:176), and DNA from the 5' end of pZP3-PA777U (SEQ ID NO:127). The insertion junction was at nucleotide position 3159605 on chromosome F. The insertion site was 154 bp upstream of the start codon of ORF YALi0F24167g (SEQ ID NO:91), an ORF that is weakly similar to the *S. cerevisiae* ORF YOR313C(SPS4) encoding a sporulation specific protein.

The 3'-end junction was obtained by PCR using primers 4305ZP3-3-2 (SEQ ID NO:167) and 79-3-POX-3 (SEQ ID NO:168). The reaction mixture included 1 µl each of 20 µM primer, 1 µl genomic DNA, 22 µl water and 25 µl TaKaRa ExTaq 2× premix (Takara Bio. Inc., Shiga, Japan). The thermocycler conditions were: 94° C. for 1 min, followed by 30 cycles of 94° C. for 20 sec, 55° C. for 20 sec and 72° C. for 1 min, followed by a final extension at 72° C. for 7 min. A ~300 bp DNA fragment was amplified and cloned into pCR2.1-TOPO.

Sequence analysis showed that it was a 326 bp chimeric fragment (SEQ ID NO:177) between *Y. lipolytica* genomic DNA from chromosome F and pZP3-PA777U (SEQ ID NO:127). The junction was at nucleotide position 3159605 of chromosome F.

Based on the 5' and 3' analyses, a DNA fragment containing the AscI/PacI fragment of pZP3-PA777U and 1729 bp of unknown DNA were inserted into chromosome F at position 3159605, 154 bp upstream of the YALi0F24167g ORF (SEQ ID NO:91).

Genome Walking to Identify the pZKL2-5U89GC Integration Site

For pZKL2-5U89GC, the following primers were designed for genome walking: KL2-5-2 (SEQ ID NO:169), KL2-5-3 (SEQ ID NO:170), KL2-3-2 (SEQ ID NO:171), and KL2-3-3 (SEQ ID NO:172). Genome walking for the 5'-insertion junction was performed using the same set of Y4305 genomic DNA ligation mixtures as described for pZKD2-5U89A2, using identical conditions, with the exception that: 1) primer KL2-5-2 replaced KL2-3-1 in the first round of PCR; and, 2) primer KL2-5-3 replaced KD2-3-2 in the second round of PCR. A 519 bp fragment from one of the reaction products was cloned into pCR2.1-TOPO and sequenced. BLAST analysis showed that this 519 bp fragment (SEQ ID NO:178) contained DNA from *Y. lipolytica* chromosome C and the 5' end of the AscI/SphI fragment of pZKL2-5U89GC. The junction was at position 2568793. More specifically, 66 bp of unknown DNA (SEQ ID NO:179) were inserted between chromosome C and pZKL2-5U89GC (SEQ ID NO:131).

Genome walking for the 3'-insertion junction was carried out exactly the same as that for the 5'-insertion junction, except that: 1) primer KL2-3-2 was used in place of KL2-5-2 in the first round of PCR; and, 2) primer KL2-3-3 replaced KL2-5-3 in the second round of PCR. A 711 bp fragment from one of the PCR products was cloned into pCR2.1-TOPO and sequenced. BLAST analysis showed that this 711 bp fragment (SEQ ID NO:180) contained DNA from *Y. lipolytica* chromosome C and pZKL2-5U89GC. The junction was at position 2568787. Thus, a 65 bp of unknown DNA (SEQ ID NO:181) was inserted between chromosome C and pZKL2-5U89GC.

Based on the analyses of the 5' and 3' junctions, the AscI/SphI fragment from pZKL2-5U89GC was inserted into chromosome C of *Y. lipolytica*. It replaced a 5 bp nucleotide segment of chromosome C between 2568787 and 2568793. Sixty-six (66) bp of unknown DNA were inserted between position 2568793 and the 5'-end of the AscI/SphI fragment of pZKL2-5U89GC and 66 bp of unknown DNA were inserted between position 2568787 and the 3'-end of the AscI/SphI fragment of PZKL2-5U89GC. The insertion deleted the first nucleotide 'A' of the translation start codon for ORF YALi0C18711g (SEQ ID NO:89), which is a homolog of the *S. cerevisiae* gene YLR050C. The insertion thus destroyed the start codon and separated the promoter region away from the nonfunctional ORF.

Example 10

Fermentation of *Yarrowia lipolytica* Strain Y4305

The present Example describes a 2-L fermentation of *Yarrowia lipolytica* strain Y4305 (Example 3), over a period of 162 hours. The lipid profile was monitored every 4 to 15 hours. Maximum EPA was 55.6% of the total lipid produced after 148 hrs, corresponding to 12.1 EPA % DCW.

Seed culture: To prepare the seed culture in a shake flask, thawed frozen glycerol stock of the genetically engineered strain of *Yarrowia lipolytica* Y4305 (0.1 mL) was transferred to a 500 mL shake flask containing 50 mL complex medium, which contained D-glucose (20 g/L), yeast nitrogen base without amino acids (3.4 g/L), $KH_2PO_4$ (6.0 g/L), $Na_2HPO_4 \cdot 12H_2O$ (3.3 g/L), $MgSO_4 \cdot 7H_2O$ (1.5 g/L) and thiamine-HCl (1.5 mg/L). The flask culture was incubated for 48 hr at 30° C. to an optical density at 600 nm ($OD_{600}$) of about 2.

Fermentation: A 2-liter Biostat® B fermentor (B.Braun Biotech International, Germany) was used for the fermentation experiment. The shake-flask seed culture (50 mL, $OD_{600}$~2) from above was transferred to the 2-liter Biostat® B fermentor to initiate the fermentation (t=0 hr) containing 950 mL fresh fermentation medium. The fresh fermentation medium included yeast extract (5.0 g), yeast nitrogen base without amino acids (6.7 g), $KH_2PO_4$ (6.0 g), $Na_2HPO_4 \cdot 12H_2O$ (3.3 g), $MgSO_4 \cdot 7H_2O$ (1.5 g), thiamine-.HCl (1.5 mg), D-glucose (50 g), trace metal solution (100×) (24 mL), and antifoam 204 (0.2 mL; Sigma Aldrich, St. Louis, Mo.). The trace metal solution (100×) contained citric acid (10 g/L), $CaCl_2 \cdot 2H_2O$ (1.5 g/L), $FeSO_4 \cdot 7H_2O$ (10 g/L), $ZnSO_4 \cdot 7H_2O$ (0.39 g/L), $CuSO_4 \cdot 5H_2O$ (0.38 g/L), $CoCl_2 \cdot 6H_2O$ (0.20 g/L), and $MnCl_2 \cdot 4H_2O$ (0.30 g/L). The dissolved oxygen concentration ($pO_2$) was controlled above zero by cascade-controlling the impeller speed between 80 and 1200 rpm. The aeration rate was controllled between 1.0 L/min to 2.0 L/min. Glucose (600 g/L) feeding commenced when its concentration in the medium decreased below 20 g/L. Glucose concentrations were maintained within 20-60 g/L during the entire fermentation process.

The acid for the pH control was $H_3PO_4$ (20%, w/v). The base for the pH control was $NH_4OH$ (28% $NH_3$, w/v) in growth phase and then switched to KOH (56%, w/v) in lipid production phase. The temperature was controlled between 30-32° C. and pH value was controlled between 5-7, respectively.

The fermentation experiment was run for 162 hours. Fermentation samples (10-20 mL) were taken every 4-15 hours to measure the intracellular lipid concentration, lipid profile, optical density of cells, dry cell weight (DCW), concentrations of glucose, major cations, and organic acids. The intracellular lipid of the *Yarrowia* cells was extracted out by methanol and chloroform and its concentration and profiles were determined by GC, according to the methodology in the General Methods.

Results: Dry cell weight (DCW), total lipid (TFAs % DCW) and the composition of each individual fatty acid, presented as a % of the total fatty acids, are shown below in Table 23, at each of the 15 time points during the 162 hr fermentation.

TABLE 23

Lipid Composition Of *Yarrowia lipolytica* Strain Y4305 During A 162-Hour Fermentation

| time (hr) | DCW (g/L) | TFAs % DCW | 16:0 palmitic | 16:1 palmit-oleic | 18:0 stearic | 18:1 oleic | 18:2 linoleic | 18:3 (n-3) ALA | 20:2 EDA | 20:3 (n-6) DGLA | 20:4 ARA | EtrA | 20:4 (5, 11, 14, 17) ETA | 20:4 (n-3) ETA | 20:5 EPA | other |
|---|---|---|---|---|---|---|---|---|---|---|---|---|---|---|---|---|
| 22.4 | 1.02 | 6.7 | 15.1 | 1.7 | 2.4 | 2.7 | 41.4 | 1.6 | 4.0 | 2.1 | 0.8 | 0.0 | 0.0 | 0.0 | 26.6 | 1.7 |
| 26.2 | 2.42 | 6.2 | 15.4 | 1.6 | 1.8 | 3.4 | 42.0 | 1.4 | 3.5 | 1.8 | 1.1 | 0.6 | 0.0 | 0.6 | 24.0 | 2.8 |
| 37.9 | 22.10 | 9.0 | 13.6 | 2.1 | 1.2 | 6.0 | 43.2 | 1.9 | 3.7 | 1.2 | 0.8 | 0.6 | 0.1 | 0.4 | 21.1 | 4.2 |
| 49.7 | 49.44 | 12.7 | 8.4 | 2.2 | 1.3 | 12.2 | 34.4 | 3.1 | 6.2 | 1.1 | 0.5 | 1.3 | 0.2 | 0.6 | 23.8 | 4.7 |
| 58.2 | 54.32 | 15.5 | 7.1 | 1.9 | 1.5 | 12.6 | 29.0 | 3.9 | 6.2 | 1.0 | 0.4 | 1.6 | 0.4 | 0.8 | 29.2 | 4.4 |
| 68.3 | 52.76 | 18.6 | 5.6 | 1.5 | 1.6 | 12.2 | 26.6 | 4.6 | 5.7 | 1.0 | 0.3 | 1.7 | 0.6 | 0.9 | 33.2 | 4.3 |
| 75.7 | 52.59 | 19.8 | 4.5 | 1.3 | 1.5 | 11.2 | 25.4 | 4.7 | 5.2 | 1.1 | 0.3 | 1.5 | 0.6 | 1.1 | 37.3 | 4.2 |
| 89.9 | 50.45 | 21.6 | 3.3 | 1.1 | 1.3 | 9.4 | 23.6 | 4.4 | 4.2 | 1.4 | 0.4 | 1.1 | 0.6 | 1.3 | 43.3 | 4.6 |
| 99.7 | 50.13 | 21.7 | 2.9 | 1.0 | 1.2 | 8.2 | 22.6 | 4.1 | 3.7 | 1.5 | 0.4 | 0.9 | 0.7 | 1.3 | 46.9 | 4.5 |

TABLE 23-continued

Lipid Composition Of *Yarrowia lipolytica* Strain Y4305 During A 162-Hour Fermentation

| time (hr) | DCW (g/L) | TFAs % DCW | 16:0 palmitic | 16:1 palmit- oleic | 18:0 stearic | 18:1 oleic | 18:2 linoleic | 18:3 (n-3) ALA | 20:2 EDA | 20:3 (n-6) DGLA | 20:4 ARA | EtrA | 20:4 (5, 11, 14, 17) | 20:4 (n-3) ETA | 20:5 EPA | other |
|---|---|---|---|---|---|---|---|---|---|---|---|---|---|---|---|---|
| 113.9 | 46.57 | 22.7 | 2.6 | 0.9 | 1.1 | 6.9 | 20.9 | 3.5 | 3.1 | 1.7 | 0.5 | 0.8 | 0.7 | 1.4 | 51.1 | 5.0 |
| 123.7 | 45.60 | 21.8 | 2.4 | 0.8 | 1.0 | 6.3 | 19.7 | 3.1 | 2.9 | 1.8 | 0.6 | 0.8 | 0.7 | 1.4 | 53.6 | 5.1 |
| 137.9 | 44.67 | 21.90 | 2.4 | 0.8 | 1.0 | 5.8 | 18.5 | 2.8 | 2.7 | 1.8 | 0.6 | 0.7 | 0.7 | 1.3 | 55.4 | 5.6 |
| 147.8 | 45.47 | 21.70 | 2.5 | 0.8 | 1.1 | 5.8 | 18.3 | 2.6 | 2.6 | 1.7 | 0.6 | 0.8 | 0.7 | 1.3 | 55.6 | 5.6 |
| 162.1 | 44.94 | 20.80 | 2.8 | 0.8 | 1.1 | 6.0 | 18.5 | 2.5 | 2.6 | 1.7 | 0.6 | 0.8 | 0.7 | 1.2 | 54.6 | 5.8 |

Thus, the results at 89.9 hrs within the fermentation demonstrate production of a microbial oil having at least about 43.3% EPA, less than about 23.6% LA (18:2) and less than about 9.4% oleic acid (18:1), wherein each fatty acid is as a % of the TFAs. The microbial oil may additionally comprise less than about 4.2% EDA as a % of the TFAs.

The total ω-3 content as % TFAs is determined by summation of the % TFAs for ALA, ETrA, juniperonic acid (cis-5, 11,14,17-eicosatetraenoic acid, 20:4), ETA and EPA. The ω-3 content is greater than 50.7% as a percent of the TFAs, from 89.9 hrs through 162.1 hrs of the fermentation, reaching a maximum level of 61% (147.8 hrs).

Similarly, EPA % DCW at each time point was calculated using the formula: [(eicosapentaenoic acid % TFAs)*(TFA % DCW)]/100. At 89.9 hrs within the fermentation, the EPA % DCW is 9.35; at all other subsequent time points through the fermentation, the EPA % DCW is increased, with a maximum level at 137.9 hrs of 12.13 EPA % DCW.

One of skill in the art of fermentation will know that variability will occur in the oil profile of a specific *Yarrowia* strain (e.g., Y4305), depending on the fermentation run itself, media conditions, process parameters, scale-up, etc., as well as the particular time-point in which the culture is sampled (as demonstrated in Table 23). As a result, for example, one can envision that the microbial oil resulting from fermentation of strain Y4305 may comprise at least about 43% EPA, less than about 24% LA (18:2), less than about 10% oleic acid (18:1), less than about 4% EDA, less than about 2% ETA, less than about 1% ARA, less than about 4% stearic acid (18:0) and less than about 4% palmitic acid (16:0), wherein each fatty acid is as a % of the TFAs.

SEQUENCE LISTING (201 sequences)

SEQ ID NO: 1 - DNA, 1936 bp, Yarrowia lipolytica
  CDS (283)..(1539)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: U.S. 7,214,491
  ref <311>: PATENT FILING DATE: 2004-05-06
  ref <312>: PUBLICATION DATE: 2007-05-08
  ref <313>: RELEVANT RESIDUES IN SEQ ID NO: (1)..(1936)
  ref <302>: TITLE: A  DELTA-12 DESATURASE GENE SUITABLE FOR ALTERING LEVELS OF POLYUNSATURATED FATTY ACIDS IN OLEAGINOUS YEASTS
  ref <310>: PATENT DOCUMENT NUMBER: WO 2004/104167
  ref <311>: PATENT FILING DATE: 2004-05-07
  ref <312>: PUBLICATION DATE: 2004-12-02
  ref <313>: RELEVANT RESIDUES IN SEQ ID NO: (1)..(1936)
cgtagttatatacaagaggtagatgcgtgctggtgttagaggggctctcaggattaggaggaaaatttgacattggccctcaacatataacctcgggtgtgcctctgtttaccctcagcttttgcttgtccccaagtcagtcacgccaggccaaaaaggttggtggattgacagggagaaaaaaaaaagcctagtgggtttaaactcgaggtaagacattgaaatatataccggtcggcatcctgagtccctttctcgtattccaacagaccgaccatagaaatggattcgaccacgcagaccaacaccggcaccggcaaggtggccgtgcagccccccacggccttcattaagcccattgagaaggtgtccgagcccgtctacgacacctttggcaacgagttcactcctccagactactctatcaaggatattctggatgccattccccaggagtgctacaagcggtcctacgttaagtcctactcgtacgtggcccgagactgcttctttatcgccgtttttgcctacatggcctacgcgtacctgcctcttattccctcggcttccggccgagctgtggcctgggccatgtactccattgtccagggtctgtttggcaccggtctgtgggttcttgcccacgagtgtggccactctgctttctccgactctaacaccgtcaacaacgtcaccggatgggttctgcactcctccatgctggtcccttactacgcctggaagctgacccactccatgcaccacaagtccactggtcacctcacccgtgatatggtgtttgtgcccaaggaccgaaaggagtttatggagaaccgaggcgcccatgactggtctgagcttgctgaggacgctcccctcatgaccctctacggcctcatcacccagcaggtgtttggatggcctctgtatctgctgtcttacgttaccggacagaagtaccccaagctcaacaaatgggctgtcaaccacttcaaccccaacgccccgctgtttgagaagaaggactggttcaacatctggatctctaacgtcggtattggtatcaccatgtccgtcatcgcatactccatcaaccgatggggcctggcttccgtcaccctctactacctgatcccctacctgtgggtcaaccactggctcgtggccatcacctacctgcagcacaccgaccccactctgccccactaccacgccgaccagtggaacttcacccgaggagccgccgccaccatcgaccgagagtttggcttcatcggctccttctgcttccatgacatcatcgagacccacgttctgcaccactacgtgtctcgaattcccttctacaacgcccgaatcgccactgagaagatcaagaaggtcatgggcaagcactaccgacacgacgacaccaacttcatcaagtctctttacactgtcgcccgaacctgccagtttgttgaaggtaaggaaggcattcagatgtttagaaacgtcaatggagtcggagttgctcctgacggcctgccttctaaaaagtagagctagaaatgttatttgattgtgttttaactgaacagcaccgagcccgaggctaagccaagcgaagccgaggggttgtgtagtccatggacgtaacgagtaggcgatatcaccgcactcggcactgcgtgtctgcgttcatgggcgaagtcacattacgctgacaaccgttgtagtttccctttagtatcaatactgttacaagtaccggtctcgtactcgtactgatacgaatctgtgggaagaagtcacccttatcagaccttcatactgatgtttcggatatcaatagaactggcatagagccgttaaagaagtttcacttaatcactccaaccctcctacttgtagattcaagcagatcgataagatggatttgatggtcagtgctagc

SEQ ID NO: 2 - protein, 419 aa, Yarrowia lipolytica
MDSTTQTNTGTGKVAVQPPTAFIKPIEKVSEPVYDTFGNEFTPPDYSIKDILDAIPQECYKRSYVKSYSYVARDCFFIAVFAYMAYAYLPLIPSASGRAVAWAMYSIVQGLFGTGLWVLAHECGHSAFSDSNTVNNVTGWVLHSSMLVPYYAWKLTHSMHHKSTGHLTRDMVFVPKDRKEFMENRGAHDWSELAEDAPLMTLYGLITQQVFGWPLYLLSYVTGQKYPKLNKWAVNHFNPNAPLFEKKDWFNIWISNVGIGITMSVIAYSINRWGLASVTLYYLIPYLWVNHWLVAITYLQHTDPTLPHYHADQWNFTRGAAATIDREFGFIGSFCFHDIIETHVLHHYVSRIPFYNARIATEKIKKVMGKHYRHDDTNFIKSLYTVARTCQFVEGKEGIQMFRNVNGVGVAPDGLPSKK

SEQ ID NO: 3 - DNA, 10 bp, Yarrowia lipolytica
  misc_feature (8)..(8): n is a, c, g, or t
  ref <302>: TITLE: PRODUCTION OF POLYUNSATURATED FATTY ACIDS IN OLEAGINOUS YEASTS
  ref <310>: PATENT DOCUMENT NUMBER: U.S. 7,238,482
  ref <311>: PATENT FILING DATE: 2004-05-06
  ref <312>: PUBLICATION DATE: 2007-07-03
  ref <313>: RELEVANT RESIDUES IN SEQ ID NO: (1)..(10)
  ref <302>: TITLE: PRODUCTION OF POLYUNSATURATED FATTY ACIDS IN OLEAGINOUS YEASTS
  ref <310>: PATENT DOCUMENT NUMBER: WO 2004/101757
  ref <311>: PATENT FILING DATE: 2004-05-07
  ref <312>: PUBLICATION DATE: 2004-11-25
  ref <313>: RELEVANT RESIDUES IN SEQ ID NO: (1)..(10)
mammatgnhs

SEQ ID NO: 4 - DNA, 777 bp, Euglena gracilis
  CDS (1)..(777): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtggtgaatgaaatagtctcaattgggcaggaagttttacccaaagttgattatgcccaactctggagtgatgccagtcactgtgaggtgctttacttgtccatcgcatttgtcatcttgaagttcactcttggcccccttggtccaaaaggtcagtctcgtatgaagtttgttttcaccaattacaaccttctcatgtccatttattcgttgggatcattcctctcaatggcatatgccatgtacaccatcggtgttatgtctgacaactgcgagaaggcttttgacaacaacgtcttcaggatcaccacgcagttgttctatttgagcaagttcctggagtatattgactccttctatttgccactgatgggcaagcctctgacctggttgcaattcttccatcatttgggggcaccgatggatatgtggctgttctataattaccgaaatgaagctgtttggatttttgtgctgttgaatggtttcatccactggatcatgtacggttattattggaccagattgatcaagctgaagttccccatgccaaaatccctgattacatcaatgcagatcattcaattcaatgttggtttctacattgtctggaagtacaggaacattccctgttatcgccaagatgggatgaggatgtttggctggttcttcaattacttttatgttggcacagtcttgtgtttgttcttgaatttctatgtgcaaacgtatatcgtcaggaagcacaagggagccaaaaagattcagtga

SEQ ID NO: 5 - protein, 258 aa, Euglena gracilis
MEVVNEIVSIGQEVLPKVDYAQLWSDASHCEVLYLSIAFVILKFTLGPLGPKGQSRMKFVFTNYNLLMSIYSLGSFLSMAYAMYTIGVMSDNCEKAFDNNVFRITTQLFYLSKFLEYIDSFYLPLMGKPLTWLQFFHHLGAPMDMWLFYNYRNEAVWIFVLLNGFIHWIMYGYYWTRLIKLKFPMPKSLITSMQIIQFNVGFYIVWKYRNIPCYRQDGMRMFGWFFNYFYVGTVLCLFLNFYVQTYIVRKHKGAKKIQ

SEQ ID NO: 6 - DNA, 777 bp, Euglena gracilis
  CDS (1)..(777): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(777)
  ref <302>: TITLE: DELTA-9 ELONGASES AND THEIR USE IN MAKING POLYUNSATURATED FATTY ACIDS
  ref <310>: PATENT DOCUMENT NUMBER: US-2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(777)
atggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtga

SEQ ID NO: 7 - protein, 258 aa, Euglena gracilis; identical to SEQ ID NO: 5

SEQ ID NO: 8 - DNA, 792 bp, Eutreptiella sp. CCMP389
  CDS (1)..(792): delta-9 elongase
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgcggtgatagaggtcgccaacgagtttgtagccatcacggcagaaacgctccccaaagttgactatcaacgactatggcgagacatttacagttgtgagctactgtatttctccattgccttcgtgatcttgaagtttacgttgggcgagttgagcgacagcggaaaaaagattttgagagtgttgttcaagtggtacaatctcttcatgtccgtgttctccttggtgtctttcctttgcatgggctatgccatttataccgtgggcctatactctaacgaatgcgacagggctttcgacaactcgttgttccgctttgcaacaaaggtgttctactacagtaagtttttggagtacatcgactctttttatcttccgctcatggccaagccgctgtctttcctgcaattcttccatcacttgggagcccccatggacatgtggctctttgtccaatattctggggaatctatttggatctttgtgtttttgaatgggttcattcactttgttatgtacgggtactactggactcggctgatgaagttcaatttcccaatgcccaagcagttgattaccgcgatgcagatcacgcagttcaacgttggtttctacctcgtgtggtggtacaaagatattccctgctaccgaaaggatcccatgcgaatgttggcctggatcttcaattactggtatgttgggactgtcttgctgctgttcattaatttcttcgtcaaatcctatgtgttcccaaagccgaagactgcagataaaaaggtccaatag

SEQ ID NO: 9 - protein, 263 aa, Eutreptiella sp. CCMP389
MAAVIEVANEFVAITAETLPKVDYQRLWRDIYSCELLYFSIAFVILKFTLGELSDSGKKILRVLFKWYNLFMSVFSLVSFLCMGYAIYTVGLYSNECDRAFDNSLFRFATKVFYYSKFLEYIDSFYLPLMAKPLSFLQFFHHLGAPMDMWLFVQYSGESIWIFVFLNGFIHFVMYGYYWTRLMKFNFPMPKQLITAMQITQFNVGFYLVWWYKDIPCYRKDPMRMLAWIFNYWYVGTVLLLFINFFVKSYVFPKPKTADKKVQ

SEQ ID NO: 10 - DNA, 792 bp, Eutreptiella sp. CCMP389
  CDS (1)..(792): synthetic delta-9 elongase (codon-optimized for Yarrowia lipolytica)
  ref <302>: TITLE: DELTA-9 ELONGASES AND THEIR USE IN MAKING POLYUNSATURATED FATTY ACIDS
  ref <310>: PATENT DOCUMENT NUMBER: WO 2007/061742
  ref <311>: PATENT FILING DATE: 2006-11-16
  ref <312>: PUBLICATION DATE: 2007-05-31
  ref <313>: RELEVANT RESIDUES IN SEQ ID NO: (1)..(792)
  ref <302>: TITLE: DELTA-9 ELONGASES AND THEIR USE IN MAKING POLYUNSATURATED FATTY ACIDS
  ref <310>: PATENT DOCUMENT NUMBER: US 2007-0117190-A1
  ref <311>: PATENT FILING DATE: 2006-11-16
  ref <312>: PUBLICATION DATE: 2007-05-24
  ref <313>: RELEVANT RESIDUES IN SEQ ID NO: (1)..(792)
atggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtag

SEQ ID NO: 11 - protein, 263 aa, Eutreptiella sp. CCMP389; identical to SEQ ID NO: 9

SEQ ID NO: 12 - DNA, 774 bp, Euglena anabaena UTEX 373
  CDS (1)..(774): delta-9 elongase
atggaagcagccaaagaattggtttccatcgtccaagaggagctccccaaggtggactatgcccagctttggcaggatgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacggcgttcaacaacgatgtgttcaggatcacaactcagctgttctacctcagcaagttcgtagagtacatcgactccttctaccttccccttatggacaagccactgtcgttccttcagttcttccatcatttgggggcccccattgacatgtggctattctacaaataccgcaacgaaggagtctggatctttgtcctgttgaatgggttcattcactggatcatgtacggttactattggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtatgtcgggacggtcttgctgctgttcctcaacttttacgtgcagacgtacatccggaagccgaggaagaaccgagggaagaaggag

SEQ ID NO: 13 - protein, 258 aa, Euglena anabaena UTEX 373
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNRGKKE

SEQ ID NO: 14 - DNA, 774 bp, Euglena anabaena UTEX 373
  CDS (1)..(774): synthetic delta-9 elongase (codon-optimized for Yarrowia lipolytica)
atggaggctgccaaggagctggtctccatcgtccaggaggaacttcccaaggtggactacgcccagctctggcaggacgcctcctcttgcgaggttctgtacctctcggtcgctttcgtggccatcaagttcatgcttcgacctctggacctcaagcgacaagccaccctcaaaaagctgttcaccgcatacaactttctcatgtccatctactcgttcggctccttcctggcgatggcctacgctctctctgtcactggtattctttccggcgattgtgagactgccttcaacaatgacgtgttccgaatcaccactcagctgttctacctcagcaagttcgtcgagtacatcgactccttctaccttcccctcatggacaagcccttgtcgtttctgcagttctttcaccatctcggagctcccatcgacatgtggctgttctacaagtatcgaaacgaaggcgtctggatctttgttctgctcaacggcttcattcactggatcatgtacggttactattggacgcgactcatcaagctgaacttccctatgcccaagaacctcattacctccatgcaaattatccagttcaacgtcggattctacatcgtctggaagtaccgaaacgtgccctgctaccggcaggacggtatgcgaatgtttgcctggatcttcaactactggtatgtcggcacggtgctgcttctgttcctcaacttctacgtccagacctacattcggaagcctcgaaagaaccgaggcaaaaaggag

SEQ ID NO: 15 - protein, 258 aa, Euglena anabaena UTEX 373; identical to SEQ ID NO: 13

SEQ ID NO: 16 - DNA, 774 bp, Euglena anabaena UTEX 373
  CDS (1)..(774): delta-9 elongase
atggaagcagccaaagaattggtttccatcgtccaagaggagctccccaaggtggactatgcccagctttggcaggacgccagcagctgtgaggtcctttacctctcggtggcattcgtggcgatcaagttcatgctgcgcccactggacctgaagcgccaggccaccttgaagaagctgttcacagcatacaacttcctcatgtcgatctattcctttggctccttcctggccatggcctatgccctatcagtaactggcatcctctccggcgactgtgagacagcgttcaacaacgatgtgttcaggatcacaactcagctgttctacctcagcaagttcgtagagtacatcgactccttctaccttccccttatggacaagccactgtcgttccttcagttcttccatcatttgggggctcccattgacatgtggctattctacaaataccgcaacgaaggagtctggatctttgtcctgttgaatgggttcattcactggatcatgtacggttactactggacgcggctcatcaagctgaacttccccatgcccaagaacctgatcacctccatgcagatcatccagttcaatgtcgggttctacatcgtctggaagtaccgcaatgtgccatgctaccgccaggatgggatgcgcatgtttgcctggatcttcaactactggtacgtcgggacggtcttgctgctgttcctcaacttttacgtgcagacgtacatccggaagccgaggaagaaccaagggaagaaggag

SEQ ID NO: 17 - protein, 258 aa, Euglena anabaena UTEX 373
MEAAKELVSIVQEELPKVDYAQLWQDASSCEVLYLSVAFVAIKFMLRPLDLKRQATLKKLFTAYNFLMSIYSFGSFLAMAYALSVTGILSGDCETAFNNDVFRITTQLFYLSKFVEYIDSFYLPLMDKPLSFLQFFHHLGAPIDMWLFYKYRNEGVWIFVLLNGFIHWIMYGYYWTRLIKLNFPMPKNLITSMQIIQFNVGFYIVWKYRNVPCYRQDGMRMFAWIFNYWYVGTVLLLFLNFYVQTYIRKPRKNQGKKE

SEQ ID NO: 18 - DNA, 1271 bp, Euglena gracilis
  CDS (4)..(1269): delta-8 desaturase ("Eg5" or "EgD8")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1271)
  ref <302>: TITLE: DELTA-8 DESATURASE AND ITS USE IN MAKING POLYUNSATURATED FATTY ACIDS
  ref <310>: PATENT DOCUMENT NUMBER: U.S. 7,256,033
  ref <311>: PATENT FILING DATE: 2005-06-24
  ref <312>: PUBLICATION DATE: 2007-08-14
  ref <313>: RELEVANT RESIDUES IN SEQ ID NO: (1)..(1271)
gaaatgaagtcaaagcgccaagcgcttccccttacaattgatggaacaacatatgatgtgtctgcctgggtcaatttccaccctggtggtgcggaaattatagagaattaccaaggaagggatgccactgatgccttcatggttatgcactctcaagaagccttcgacaagctcaagcgcatgcccaaaatcaatcccagttctgagttgccaccccaggctgcagtgaatgaagctcaagaggatttccggaagctccgagaagagttgatcgcaactggcatgtttgatgcctcccccctctggtactcatacaaaatcagcaccacactgggccttggagtgctgggttatttcctgatggttcagtatcagatgtatttcattggggcagtgttgcttgggatgcactatcaacagatgggctggctttctcatgacatttgccaccaccagactttcaagaaccggaactggaacaacctcgtgggactggtatttggcaatggtctgcaaggtttttccgtgacatggtggaaggacagacacaatgcacatcattcggcaaccaatgttcaagggcacgaccctgatattgacaacctccccctcttagcctggtctgaggatgacgtcacacgggcgtcaccgatttcccgcaagctcattcagttccagcagtactatttcttggtcatctgtatcttgttgcggttcatttggtgtttccagagcgtgttgaccgtgcgcagtttgaaggacagagataaccaattctatcgctctcagtataagaaggaggccattggcctcgccctgcactggaccttgaagaccctgttccacttattctttatgcccagcatcctcacatcgctgttggtgtttttcgtttcggagctggttggcggcttcggcattgcgatcgtggtgttcatgaaccactacccactggagaagatcggggactcagtctgggatggccatggattctcggttggccagatccatgagaccatgaacattcggcgagggattatcacagattggtttttcggaggcttgaattaccagattgagcaccatttgtggccgaccctccctcgccacaacctgacagcggttagctaccaggtggaacagctgtgccagaagcacaacctgccgtatcggaacccgctgccccatgaagggttggtcatcctgctgcgctatctggcggtgttcgcccggatggcggagaagcaacccgcggggaaggctctataagg

SEQ ID NO: 19 - protein, 421 aa, Euglena gracilis
MKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 20 - DNA, 1272 bp, Euglena gracilis
  CDS (2)..(1270): synthetic delta-8 desaturase (codon-optimized for Yarrowia lipolytica) ("D8SF" or "EgD8S")
  ref <302>: TITLE: DELTA-8 DESATURASE AND ITS USE IN MAKING POLYUNSATURATED FATTY ACIDS
  ref <310>: PATENT DOCUMENT NUMBER: WO 2006/012325 and WO 2006/012326
  ref <311>: PATENT FILING DATE: 2005-06-24
  ref <312>: PUBLICATION DATE: 2006-02-02
  ref <313>: RELEVANT RESIDUES IN SEQ ID NO: (1)..(1272)
  ref <302>: TITLE: DELTA-8 DESATURASE AND ITS USE IN MAKING POLYUNSATURATED FATTY ACIDS
  ref <310>: PATENT DOCUMENT NUMBER: U.S. 7,256,033
  ref <311>: PATENT FILING DATE: 2005-06-24
  ref <312>: PUBLICATION DATE: 2007-08-14
  ref <313>: RELEVANT RESIDUES IN SEQ ID NO: (1)..(1272)
catggtgaagtccaagcgacaggctctgcccctcaccatcgacggaactacctacgacgtctccgcttgggtgaacttccaccctggtggagctgaaatcattgagaactaccagggacgagatgctactgacgccttcatggttatgcactctcaggaagccttcgacaagctcaagcgaatgcccaagatcaacccctcctccgagctgcctccccaggctgccgtcaacgaagctcaggaggatttccgaaagctccgagaagagctgatcgccactggcatgtttgacgcctctcccctctggtactcgtacaagatctccaccaccctgggtcttggcgtgcttggatacttcctgatggtccagtaccagatgtacttcattggtgctgtgctgctcggtatgcactaccagcaaatgggatggctgtctcatgacatctgccaccaccagaccttcaagaaccgaaactggaataacctcgtgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgctcctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctggccgtgttcgctcgaatggccgagaagcagcccgctggcaaggctctctaagc

SEQ ID NO: 21 - protein, 422 aa, Euglena gracilis
MVKSKRQALPLTIDGTTYDVSAWVNFHPGGAEIIENYQGRDATDAFMVMHSQEAFDKLKRMPKINPSSELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSLLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 22 - DNA, 1272 bp, Artificial Sequence
  mutant EgD8S-23 delta-8 desaturase
  CDS (2)..(1270)
  ref <302>: TITLE: MUTANT DELTA-8 DESATURASE GENES ENGINEERED BY TARGETED MUTAGENSIS AND THEIR USE IN MAKING POLYUNSATURATED FATTY ACIDS
  ref <310>: PATENT DOCUMENT NUMBER: WO 2008/073271
  ref <311>: PATENT FILING DATE: 2007-12-05
  ref <312>: PUBLICATION DATE: 2008-06-19
  ref <313>: RELEVANT RESIDUES IN SEQ ID NO: (1)..(1272)
  ref <302>: TITLE: MUTANT DELTA-8 DESATURASE GENES ENGINEERED BY TARGETED MUTAGENSIS AND THEIR USE IN MAKING POLYUNSATURATED FATTY ACIDS
  ref <310>: PATENT DOCUMENT NUMBER: US 2008-0138868-A1
  ref <311>: PATENT FILING DATE: 2006-12-07
  ref <312>: PUBLICATION DATE: 2008-06-12
  ref <313>: RELEVANT RESIDUES IN SEQ ID NO: (1)..(1272)
catggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagc

SEQ ID NO: 23 - protein, 422 aa, Artificial Sequence
  Synthetic Construct
MVKASRQALPLVIDGKVYDVSAWVNFHPGGAEIIENYQGRDATDAFMVMHSQEAFDKLKRMPKINQASELPPQAAVNEAQEDFRKLREELIATGMFDASPLWYSYKILTTLGLGVLAFFMLVQYHLYFIGALVLGMHYQQMGWLSHDICHHQTFKNRNWNNVLGLVFGNGLQGFSVTWWKDRHNAHHSATNVQGHDPDIDNLPLLAWSEDDVTRASPISRKLIQFQQYYFLVICILLRFIWCFQSVLTVRSLKDRDNQFYRSQYKKEAIGLALHWTLKTLFHLFFMPSILTSMLVFFVSELVGGFGIAIVVFMNHYPLEKIGDSVWDGHGFSVGQIHETMNIRRGIITDWFFGGLNYQIEHHLWPTLPRHNLTAVSYQVEQLCQKHNLPYRNPLPHEGLVILLRYLSQFARMAEKQPGAKAQ

SEQ ID NO: 24 - DNA, 1260 bp, Euglena anabaena UTEX 373
  CDS (1)..(1260): delta-8 desaturase
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 25 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 26 - DNA, 1260 bp, Euglena anabaena UTEX 373
  CDS (1)..(1260): synthetic delta-8 desaturase (codon-optimized for Yarrowia lipolytica)
atggtcaagcgacccgctctgcctctcaccgtggacggtgtcacctacgacgtttctgcctggctcaaccaccatcccggaggtgccgacattatcgagaactaccgaggtcgggatgctaccgacgtcttcatggttatgcactccgagaacgccgtgtccaaactcagacgaatgcccatcatggaaccttcctctcccctgactccaacacctcccaagccaaactccgacgaacctcaggaggatttccgaaagctgcgagacgagctcattgctgcaggcatgttcgatgcctctcccatgtggtacgcttacaagaccctgtcgactctcggactgggtgtccttgccgtgctgttgatgacccagtggcactggtacctggttggtgctatcgtcctcggcattcactttcaacagatgggatggctctcgcacgacatttgccatcaccagctgttcaaggaccgatccatcaacaatgccattggcctgctcttcggaaacgtgcttcagggcttttctgtcacttggtggaaggaccgacacaacgctcatcactccgccaccaacgtgcagggtcacgatcccgacatcgacaacctgcctctcctggcgtggtccaaggaggacgtcgagcgagctggcccgttttctcgacggatgatcaagtaccaacagtattacttctttttcatctgtgcccttctgcgattcatctggtgctttcagtccattcatactgccacgggtctcaaggatcgaagcaatcagtactatcgaagacagtacgagaaggagtccgtcggtctggcactccactggggtctcaaggccttgttctactatttctacatgccctcgtttctcaccggactcatggtgttctttgtctccgagctgcttggtggcttcggaattgccatcgttgtcttcatgaaccactaccctctggagaagattcaggactccgtgtgggatggtcatggcttctgtgctggacagattcacgagaccatgaacgttcagcgaggcctcgtcacagactggtttttcggtggcctcaactaccagatcgaacatcacctgtggcctactcttcccagacacaacctcaccgctgcctccatcaaagtggagcagctgtgcaagaagcacaacctgccctaccgatctcctcccatgctcgaaggtgtcggcattcttatctcctacctgggcaccttcgctcgaatggttgccaaggcagacaaggcc

SEQ ID NO: 27 - protein, 420 aa, Euglena anabaena UTEX 373; identical to SEQ ID NO: 25

SEQ ID NO: 28 - DNA, 1260 bp, Euglena anabaena UTEX 373
  CDS (1)..(1260): delta-8 desaturase
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcactacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccaagggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 29 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLTTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTAKGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 30 - DNA, 1260 bp, Euglena anabaena UTEX 373
  CDS (1)..(1260): delta-8 desaturase
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggattatcaagtaccagcaatactacttcttcttcatctgtgccctcctgaggttcatctggtgcttccagagcatccacacagccacgggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 31 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRIIKYQQYYFFFICALLRFIWCFQSIHTATGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 32 - DNA, 1260 bp, Euglena anabaena UTEX 373
  CDS (1)..(1260): delta-8 desaturase
atggtgaaaaggccagcacttccgctgaccgttgatggtgtcacctatgatgtgtctgcctggttgaaccatcatccagggggtgctgacatcattgagaactaccgcggtcgtgatgccactgatgtctttatggttatgcactctgaaaatgctgtgagtaaactaagaaggatgcctatcatggaaccatcatctccactgacgcctacgccaccgaaacccaactcagacgaaccgcaggaggatttccgcaagctccgagatgagctcatcgcagcaggaatgttcgacgcatcaccgatgtggtacgcatataagacgctcagtacgctgggcctcggggtcctcgcggtgctattgatgacccagtggcactggtacctcgtcggggcaatcgtgttgggcattcacttccaacaaatgggttggttgtcgcacgatatctgccaccatcagctgttcaaggaccgatcgatcaacaacgccatcggcttgcttttcgggaacgtcttgcaagggttctctgtgacctggtggaaggacaggcacaatgcacaccactccgccaccaacgtgcaaggccacgaccccgacattgacaacctgccgctgctggcatggtccaaggaggacgtggagagggccggcccgttctcacggcggatgatcaagtaccagcaatactacttcttcttcatctgtgccctcctgaggttcatctggtgcttccagagcatccacacagccaagggcctgaaggatcgcagcaaccagtactaccgcaggcagtacgagaaagagagcgtgggcctggccctccactggggcctgaaggcgttgttctactacttttatatgccaagcttcttgaccggactcatggtgtttttcgtgtccgagttgcttgggggcttcggcatcgccatcgtggtgttcatgaaccactaccccctggagaagatccaggactcggtgtgggacggccacggcttttgcgccggccagattcacgaaacgatgaacgtccagcggggactcgtcacggactggttcttcggtgggctgaattaccaaatcgagcaccacctgtggccgacgctgccccggcacaacctgacggcggccagcatcaaagtggagcagttgtgcaagaagcacaacttgccgtatcgcagccccccaatgctggagggggtgggcatcctgatcagctacctgggcacctttgcccgcatggtggcaaaggccgacaaggcg

SEQ ID NO: 33 - protein, 420 aa, Euglena anabaena UTEX 373
MVKRPALPLTVDGVTYDVSAWLNHHPGGADIIENYRGRDATDVFMVMHSENAVSKLRRMPIMEPSSPLTPTPPKPNSDEPQEDFRKLRDELIAAGMFDASPMWYAYKTLSTLGLGVLAVLLMTQWHWYLVGAIVLGIHFQQMGWLSHDICHHQLFKDRSINNAIGLLFGNVLQGFSVTWWKDRHNAHHSATNVQGHDPDIDNLPLLAWSKEDVERAGPFSRRMIKYQQYYFFFICALLRFIWCFQSIHTAKGLKDRSNQYYRRQYEKESVGLALHWGLKALFYYFYMPSFLTGLMVFFVSELLGGFGIAIVVFMNHYPLEKIQDSVWDGHGFCAGQIHETMNVQRGLVTDWFFGGLNYQIEHHLWPTLPRHNLTAASIKVEQLCKKHNLPYRSPPMLEGVGILISYLGTFARMVAKADKA

SEQ ID NO: 34 - DNA, 1350 bp, Euglena gracilis
  CDS (1)..(1350): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0292924-A1
  ref <311>: PATENT FILING DATE: 2007-05-15
  ref <312>: PUBLICATION DATE: 2007-12-20
  ref <313>: RELEVANT RESIDUES IN SEQ ID NO: (1)..(1350)
atggctctcagtcttaccacagaacagctgttagaacgccctgatttggttgcgattgatggcatcctctacgaccttgaagggcttgccaaagttcatccaggaggagatttgattctcgcttctggtgcctctgatgcctcccctctcttttattcaatgcatccatacgtcaaaccggagaattccaaattgcttcaacagttcgtccgagggaagcatgaccgcacctcgaaggacattgtctacacgtatgattctcccttcgcacaagacgttaagcggacaatgcgcgaggtgatgaaagggaggaactggtacgcaacccctggcttctggctgcgcaccgttgggatcatcgccgtgacggccttttgcgagtggcactgggctaccacggggatggtgctgtggggcctgttgactggattcatgcacatgcagatcggcttatccatccagcatgatgcgtcccacggggccatcagcaagaagccttgggtcaacgccctcttcgcctacggcattgacgtcatcggatcgtcccggtggatttggctgcagtcgcacatcatgcggcaccacacctacaccaaccagcacggcctcgacctggatgcggagtcggcagagccgttcctggtgttccacaactaccccgccgcaaacaccgcccgaaagtggttccaccgcttccaagcttggtacatgtaccttgtgctgggggcatacggggtatcgctggtgtacaacccgctctacattttccggatgcagcacaatgacaccatcccagagtctgtcacggccatgcgggagaatggctttctgcggcgctaccgcacacttgcattcgtgatgcgagctttcttcatcttccggaccgcattcttgccctggtacctcactgggacctcattgctgatcaccattcctctggtgcccactgcaactggtgccttcttgacgttcttcttcattttgtcccacaattttgatggctccgaacggatccccgacaagaactgcaaggttaagagctctgagaaggacgttgaggctgaccaaattgactggtatcgggcgcaggtggagacgtcctccacatacggtggccccatcgccatgttcttcactggcggtctcaatttccagatcgagcaccacctctttccccggatgtcgtcttggcactaccccttcgtccagcaggcggtccgggagtgttgcgaacgccatggagtgcgatatgttttctaccctaccatcgtcggcaacatcatctccaccctgaagtacatgcataaggtgggtgtcgtccactgcgtgaaggacgcacaggattcctga

SEQ ID NO: 35 - protein, 449 aa, Euglena gracilis
MALSLTTEQLLERPDLVAIDGILYDLEGLAKVHPGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 36 - DNA, 1350 bp, Euglena gracilis
  CDS (1)..(1350): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136671
  ref <311>: PATENT FILING DATE: 2007-05-16
  ref <312>: PUBLICATION DATE: 2007-11-29
  ref <313>: RELEVANT RESIDUES IN SEQ ID NO: (1)..(1350)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0292924-A1
  ref <311>: PATENT FILING DATE: 2007-05-15
  ref <312>: PUBLICATION DATE: 2007-12-20
  ref <313>: RELEVANT RESIDUES IN SEQ ID NO: (1)..(1350)
atggctctctcccttactaccgagcagctgctcgagcgacccgacctggttgccatcgacggcattctctacgatctggaaggtcttgccaaggtccatcccggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 37 - protein, 449 aa, Euglena gracilis; identical to SEQ ID NO: 35

SEQ ID NO: 38 - DNA, 1392 bp, Peridinium sp. CCMP626
  CDS (1)..(1392): delta-5 desaturase
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136646
  ref <311>: PATENT FILING DATE: 2007-05-16
  ref <312>: PUBLICATION DATE: 2007-11-29
  ref <313>: RELEVANT RESIDUES IN SEQ ID NO: (1)..(1392)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0271632-A1
  ref <311>: PATENT FILING DATE: 2007-05-15
  ref <312>: PUBLICATION DATE: 2007-11-22
  ref <313>: RELEVANT RESIDUES IN SEQ ID NO: (1)..(1392)
atggctccagatgcggacaagttgagacagcgcaaggcgcaatcgattcaagacacggctgattcgcaagctaccgaactcaagattggcaccctgaagggcttgcaggggacagaaatcgtcattgatggagacatttacgatataaaagactttgatcaccccggtggtgaatccatcatgacttttgggggaaacgatgtcaccgccacgtacaagatgatccacccctaccactctaagcaccatttggagaagatgaagaaagtgggacgagttccggactacacctcggaatacaagtttgatactccctttgagcgtgaaatcaagcaagaggtcttcaagattgtgcgacgaggccgcgagtttggaacacctggatacttcttccgggctttctgctacattggacttttcttttacttgcagtatttgtgggtcacgactcccactacctttgccttggcgatcttctatggtgtttcgcaagctttcattggtttgaacgtacaacatgatgccaaccacggagctgcctccaagaagccttggatcaataacttgctaggattgggggctgactttatcggaggttccaaatggttgtggatgaaccagcactggacgcaccacacatacaccaaccaccatgagaaggatcccgatgccttgggcgctgaaccaatgttgttgttcaatgattatcccttgggtcacccaaagcgtactttgattcaccacttccaggccttctattaccttttcgtcttggccggatactgggtctcttcggtcttcaaccctcaaattttggacttgcaacaccgcggtgctcaagcggttggaatgaaaatggagaacgattacattgccaaaagccgaaagtatgccatcttcttgcgtctcttgtatatttacaccaacattgtcgctccgatccaaaaccaaggcttctcgttgaccgtggtcgcccacattttgaccatgggcgtcgcttccagtttgactttggcgactctttttgccttgtcgcacaattttgaaaacgcggatcgcgatcccacttacgaggcccgcaagggaggagagcctgtttgttggttcaagtcgcaagtcgaaacctcgtcaacttacggaggtttcatctcgggttgcttgacgggcggactcaacttccaagtggaacaccacttgttccctcgtatgagttcggcctggtacccctacattgcccctactgttcgagaggtttgcaaaaagcacggagtcaagtacgcatactatccctgggtctggcaaaacttgatttcaactgtcaagtatctgcatcaaagcggaactggatccaactggaagaatggcgccaacccctactcgggaaaattgtaa

SEQ ID NO: 39 - protein, 463 aa, Peridinium sp. CCMP626
MAPDADKLRQRKAQSIQDTADSQATELKIGTLKGLQGTEIVIDGDIYDIKDFDHPGGESIMTFGGNDVTATYKMIHPYHSKHHLEKMKKVGRVPDYTSEYKFDTPFEREIKQEVFKIVRRGREFGTPGYFFRAFCYIGLFFYLQYLWVTTPTTFALAIFYGVSQAFIGLNVQHDANHGAASKKPWINNLLGLGADFIGGSKWLWMNQHWTHHTYTNHHEKDPDALGAEPMLLFNDYPLGHPKRTLIHHFQAFYYLFVLAGYWVSSVFNPQILDLQHRGAQAVGMKMENDYIAKSRKYAIFLRLLYIYTNIVAPIQNQGFSLTVVAHILTMGVASSLTLATLFALSHNFENADRDPTYEARKGGEPVCWFKSQVETSSTYGGFISGCLTGGLNFQVEHHLFPRMSSAWYPYIAPTVREVCKKHGVKYAYYPWVWQNLISTVKYLHQSGTGSNWKNGANPYSGKL

SEQ ID NO: 40 - DNA, 1392 bp, Peridinium sp. CCMP626
  CDS (1)..(1392): synthetic delta-5 desaturase (codon-optimized for Yarrowia lipolytica)
  ref <302>: TITLE: DELTA-5 DESATURASE AND ITS USE IN MAKING POLYUNSATURATED FATTY ACIDS
  ref <310>: PATENT DOCUMENT NUMBER: WO 2007/136646
  ref <311>: PATENT FILING DATE: 2007-05-16
  ref <312>: PUBLICATION DATE: 2007-11-29
  ref <313>: RELEVANT RESIDUES IN SEQ ID NO: (1)..(1392)
  ref <302>: TITLE: DELTA-5 DESATURASE AND ITS USE IN MAKING POLYUNSATURATED FATTY ACIDS
  ref <310>: PATENT DOCUMENT NUMBER: US 2007-0271632-A1
  ref <311>: PATENT FILING DATE: 2007-05-15
  ref <312>: PUBLICATION DATE: 2007-11-22
  ref <313>: RELEVANT RESIDUES IN SEQ ID NO: (1)..(1392)
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcaccctggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

SEQ ID NO: 41 - protein, 463 aa, Peridinium sp. CCMP626; identical to SEQ ID NO: 39

SEQ ID NO: 42 - DNA, 1362 bp, Euglena anabaena UTEX 373
  CDS (1)..(1362): delta-5 desaturase
atggccaccatctctttgactactgagcaacttttagaacacccagaactggttgcaattgatggggtgttgtacgatctcttcggactggcgaaagtgcatccaggtggcaacctcattgaagccgccggtgcctccgacggaaccgccctgttctactccatgcaccctggagtgaagccagagaattcgaagctgctgcagcaatttgcccgaggcaaacacgaacgaagctcgaaggacccagtgtacacctttgacagtcccttcgcccaggatgtcaagcagagcgttcgggaggtcatgaaggggcgcaactggtacgccacgcccggcttttggctgcggaccgcgctgatcatcgcgtgcactgccataggcgaatggtattggatcactaccggggcagtgatgtggggcatcttcaccgggtacttccacagccagattgggttggcgattcaacacgatgcctctcacggagccatcagcaaaaagccctgggtgaacgcctttttcgcctacggcatcgacgccattggatcctcccgctggatctggctgcagtcccacattatgcgccaccacacctacaccaaccagcatggcctggacctggacgctgcctcggcggagccgttcattttgttccactcctacccggcaacaaatgcgtcacgaaagtggtaccatcggttccaggcgtggtacatgtacatcgttttggggatgtatggtgtgtcgatggtgtacaatccgatgtacttgttcacgatgcagcacaacgacacaatcccagaggccacctctcttagaccaggcagctttttcaaccggcagcgcgccttcgccgtttccctccgcctactgttcatcttccgcaacgccttcctcccctggtacatcgcgggcgcctctccgctgctcaccatcctgctggtgccaacggtcacaggcatcttcttgacatttgtttttgtgctgtcccataactttgaaggcgctgagcggacccccgaaaagaactgcaaggccaaaagggccaaggaggggaaggaggtccgcgatgtagaggaggaccgggtggactggtaccgggcgcaggccgagaccgcggcgacctacgggggcagcgtcgggatgatgctgaccggcggtttgaacctgcagatcgagcaccacttgttcccccgcatgtcctcttggcactaccccttcatccaagatacggtgcgggaatgttgcaagcgccatggcgtgcgctacacatactacccgaccatcctggagaatataatgtccacgctccgctacatgcagaaggtgggcgtggcccacacaattcaggatgcccaggaattc

SEQ ID NO: 43 - protein, 454 aa, Euglena anabaena UTEX 373
MATISLTTEQLLEHPELVAIDGVLYDLFGLAKVHPGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 44 - DNA, 1362 bp, Euglena anabaena UTEX 373
  CDS (1)..(1362): synthetic delta-5 desaturase (codon-optimized for Yarrowia lipolytica)
atggccaccatctccctgactaccgagcagctcctggaacaccccgagctcgttgccatcgacggagtcctgtacgatctcttcggtctggccaaggtgcatccaggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttc

SEQ ID NO: 45 - protein, 454 aa, Euglena anabaena UTEX 373; identical to SEQ ID NO: 43

SEQ ID NO: 46 - DNA, 1086 bp, Phytophthora ramorum
  CDS (1)..(1086): delta-17 desaturase
  ref <302>: TITLE: DELTA-17 DESATURASES AND THEIR USE IN MAKING POLYUNSATURATED FATTY ACIDS
  ref <310>: PATENT DOCUMENT NUMBER: WO 2007/123999
  ref <311>: PATENT FILING DATE: 2007-04-19
  ref <312>: PUBLICATION DATE: 2007-11-01
  ref <313>: RELEVANT RESIDUES IN SEQ ID NO: (1)..(1086)
  ref <302>: TITLE: DELTA-17 DESATURASES AND THEIR USE IN MAKING POLYUNSATURATED FATTY ACIDS
  ref <310>: PATENT DOCUMENT NUMBER: US 2007-0249026-A1
  ref <311>: PATENT FILING DATE: 2007-04-18
  ref <312>: PUBLICATION DATE: 2007-10-25
  ref <313>: RELEVANT RESIDUES IN SEQ ID NO: (1)..(1086)
atggcgactaagcagccgtaccagttcccgaccctgacggagatcaagcggtcgctgcccagcgagtgctttgaggcctcggtgccgctgtcgctctactacacggtgcgcatcgtggccatcgccgtggcgctggcgttcggcctcaactacgcgcgcgcgctgcccgtggtcgagagcttgtgggcgctggacgctgcgctctgctgcggttacgtgctgctgcagggcatcgtgttctggggcttcttcacggtgggccatgacgccggccacggcgccttctcgcgttaccacctgctcaacttcgtggtgggcaccttcatccactcgctcatcctcacgcccttcgagtcgtggaagctcacgcaccgccaccaccacaagaacacgggcaacattgaccgcgacgagatcttctacccgcagcgcaaggccgacgaccacccgctgtcgcgcaacctcgtgctggcgctcggcgccgcgtggttcgcctacctggtcgagggcttcccgccccgcaaggtcaaccacttcaacccattcgagccgctgtttgtgcgccaggtggccgccgtcgtcatctcgctctccgcgcacttcgccgtgttggcgctgtccgtgtatctgagcttccagttcggtctcaagaccatggcgctctactactacggccccgtcttcgtgttcggcagcatgcttgtgatcaccaccttcctgcatcacaatgacgaggagaccccatggtacggagactccgactggacctacgtcaagggcaacctgtcgtccgtggaccggtcctacggcgcgttcatcgacaacctgagccacaacatcggcacgcaccagatccaccacctcttccccatcatcccgcactacaagctcaaccgcgctacggcggcattccaccaggccttccccgagctcgtgcgcaagagcgacgagccgatcctcaaggccttctggcgcgtcggccgactgtacgccaactacggcgtcgtggacccggacgccaagctcttcacgctcaaggaggccaaggcggcgtccgaggcggcgaccaagaccaaggccacctaa

SEQ ID NO: 47 - protein, 361 aa, Phytophthora ramorum
MATKQPYQFPTLTEIKRSLPSECFEASVPLSLYYTVRIVAIAVALAFGLNYARALPVVESLWALDAALCCGYVLLQGIVFWGFFTVGHDAGHGAFSRYHLLNFVVGTFIHSLILTPFESWKLTHRHHHKNTGNIDRDEIFYPQRKADDHPLSRNLVLALGAAWFAYLVEGFPPRKVNHFNPFEPLFVRQVAAVVISLSAHFAVLALSVYLSFQFGLKTMALYYYGPVFVFGSMLVITTFLHHNDEETPWYGDSDWTYVKGNLSSVDRSYGAFIDNLSHNIGTHQIHHLFPIIPHYKLNRATAAFHQAFPELVRKSDEPILKAFWRVGRLYANYGVVDPDAKLFTLKEAKAASEAATKTKAT

SEQ ID NO: 48 - DNA, 1086 bp, Phytophthora ramorum
  CDS (1)..(1086): synthetic delta-17 desaturase (codon-optimized for Yarrowia lipolytica)
  ref <302>: TITLE: DELTA-17 DESATURASES AND THEIR USE IN MAKING POLYUNSATURATED FATTY ACIDS
  ref <310>: PATENT DOCUMENT NUMBER: WO 2007/123999
  ref <311>: PATENT FILING DATE: 2007-04-19
  ref <312>: PUBLICATION DATE: 2007-11-01
  ref <313>: RELEVANT RESIDUES IN SEQ ID NO: (1)..(1086)
  ref <302>: TITLE: DELTA-17 DESATURASES AND THEIR USE IN MAKING POLYUNSATURATED FATTY ACIDS
  ref <310>: PATENT DOCUMENT NUMBER: US 2007-0249026-A1
  ref <311>: PATENT FILING DATE: 2007-04-18
  ref <312>: PUBLICATION DATE: 2007-10-25
  ref <313>: RELEVANT RESIDUES IN SEQ ID NO: (1)..(1086)
atggctaccaagcagccctaccagttccctactctgaccgagatcaagcgatctcttccctccgagtgctttgaagcctcggtccctctgtccttgtactacaccgtgcgaatcgtcgctattgccgttgctctggccttcggactcaactacgctcgagcccttcccgtggtcgagtctctgtgggcactcgacgctgccctttgttgcggttacgttctgctccaaggcattgtcttctggggattctttaccgtgggtcacgatgctggacatggtgccttctctcgataccacctgctcaactttgtcgttggcacctttatccactccctcattcttactcccttcgagtcgtggaagctcacacatcgacaccatcacaagaacaccggaaacatcgaccgagacgaaatcttctaccctcagcgaaaggccgacgatcatcctctgtctcgaaacctcgtcctggctctcggtgccgcttggtttgcctaccttgtcgagggctttcctccccgaaaggtcaaccacttcaaccccttcgaacctctgtttgtgcgacaggtggctgccgttgtcatttccctctctgctcacttcgccgtcctggcactgtccgtgtatctgagctttcagttcggtctcaagacaatggctctgtactactatggacccgtcttcgtgttcggctccatgctcgtcattactacctttctgcatcacaatgacgaggaaactccttggtacggagattccgactggacctacgtcaagggcaacttgtcttccgtggaccgatcttacggtgccttcatcgacaacctctcgcacaacattggcacacaccagatccaccatctgtttcccatcattcctcactacaagctcaaccgagccaccgctgccttccaccaggcctttcccgaacttgtccgaaagagcgacgagcccattctcaaggctttctggagagttggtcgactttacgccaactacggagtcgtggatcccgacgcaaagctgtttactctcaaggaggccaaagctgcctccgaggctgccaccaagaccaaggctacttaa

SEQ ID NO: 49 - protein, 361 aa, Phytophthora ramorum; identical to SEQ ID NO: 47

SEQ ID NO: 50 - DNA, 1080 bp, Pythium aphanidermatum
  CDS (1)..(1080): delta-17 desaturase
  ref <302>: TITLE: DELTA-17 DESATURASES AND THEIR USE IN MAKING POLYUNSATURATED FATTY ACIDS
  ref <310>: PATENT DOCUMENT NUMBER: WO 2008/054565
  ref <311>: PATENT FILING DATE: 2007-07-19
  ref <312>: PUBLICATION DATE: 2008-05-08
  ref <313>: RELEVANT RESIDUES IN SEQ ID NO: (1)..(1080)
  ref <302>: TITLE: DELTA-17 DESATURASES AND THEIR USE IN MAKING POLYUNSATURATED FATTY ACIDS
  ref <310>: PATENT DOCUMENT NUMBER: US 2008-0125326-A1
  ref <311>: PATENT FILING DATE: 2007-07-19
  ref <312>: PUBLICATION DATE: 2008-05-29
  ref <313>: RELEVANT RESIDUES IN SEQ ID NO: (1)..(1080)
atggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactag

SEQ ID NO: 51 - protein, 359 aa, Pythium aphanidermatum
MASSTVAAPYEFPTLTEIKRSLPAHCFEASVPWSLYYTVRALGIAGSLALGLYYARALAIVQEFALLDAVLCTGYILLQGIVFWGFFTIGHDCGHGAFSRSHLLNFSVGTLIHSIILTPYESWKISHRHHHKNTGNIDKDEIFYPQREADSHPLSRHMVISLGSAWFAYLVAGFPPRKVNHFNPWEPLYLRRMSAVIISLGSLVAFAGLYAYLTYVYGLKTMALYYFAPLFGFATMLVVTTFLHHNDEETPWYADSEWTYVKGNLSSVDRSYGALIDNLSHNIGTHQIHHLFPIIPHYKLNEATAAFAQAFPELVRKSASPIIPTFIRIGLMYAKYGVVDKDAKMFTLKEAKAAKTKAN

SEQ ID NO: 52 - DNA, 1080 bp, Pythium aphanidermatum
  CDS (1)..(1080): synthetic delta-17 desaturase (codon-optimized for Yarrowia lipolytica)
  ref <302>: TITLE: DELTA-17 DESATURASES AND THEIR USE IN MAKING POLYUNSATURATED FATTY ACIDS
  ref <310>: PATENT DOCUMENT NUMBER: WO 2008/054565
  ref <311>: PATENT FILING DATE: 2007-07-19
  ref <312>: PUBLICATION DATE: 2008-05-08
  ref <313>: RELEVANT RESIDUES IN SEQ ID NO: (1)..(1080)
  ref <302>: TITLE: DELTA-17 DESATURASES AND THEIR USE IN MAKING POLYUNSATURATED FATTY ACIDS
  ref <310>: PATENT DOCUMENT NUMBER: US 2008-0125326-A1
  ref <311>: PATENT FILING DATE: 2007-07-19
  ref <312>: PUBLICATION DATE: 2008-05-29
  ref <313>: RELEVANT RESIDUES IN SEQ ID NO: (1)..(1080)
atggcttcctctaccgttgccgctccctacgagttccctactctcaccgagatcaagcgatccctgcctgcccactgcttcgaagcctctgttccctggtccctctactataccgtgcgagctctgggcattgccggttcccttgctctcggactgtactatgctcgagcccttgctatcgtgcaggagtttgcactgctcgatgccgtcctttgcactggctacattctgctccagggtatcgtgttctggggattctttaccatcggtcacgactgtggacatggtgccttctcgcgatcccacctgctcaacttctctgttggcacactcattcactccatcattctgactccctacgagtcgtggaagatcagccatcgacaccatcacaagaacaccggcaacatcgacaaggatgagatcttctaccctcagcgagaagccgactctcatcccctgtcccgacacatggtcatctcccttggttcggcttggtttgcctacctcgttgctggatttcctccccgaaaggtcaaccacttcaatccctgggagcctctctacctgcgaagaatgtctgccgtcatcatttccctcggctctctcgtggcctttgctggtctgtacgcctaccttacctacgtctacggcctcaagaccatggctctgtattacttcgcacctctctttggattcgccaccatgctggttgtcactaccttcctccatcacaacgacgaggaaactccctggtacgccgattcggagtggacctatgtcaagggcaacttgtcctctgtggaccgaagctacggagccctcatcgacaacctgtcccacaacattggtacacatcagatccaccatctgtttcccatcattcctcactacaagctcaacgaggccactgctgccttcgctcaggcctttcccgaactggtgcgaaagtcggcttctcccatcattcccaccttcatccgaattggtcttatgtacgccaagtacggcgtggtcgacaaggatgccaagatgtttaccctcaaggaggccaaggctgccaagaccaaagccaactaa

SEQ ID NO: 53 - protein, 359 aa, Pythium aphanidermatum; identical to SEQ ID NO: 51

SEQ ID NO: 54 - DNA, 1434 bp, Fusarium monoliforme
  CDS (1)..(1434): delta-12 desaturase
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcgtccacttcggctctgcccaagcagaaccctgcgcttagacgcaccgtcacctcaactactgtgacggattctgagtctgccgccgtctctccttcagactctccccgccactcggcctcttccacatcgctctcgtccatgtccgaggttgatatcgccaagcccaagtccgagtatggtgtcatgctcgacacctacggcaaccagttcgaggttcccgactttaccatcaaggacatctacaatgccatccctaagcactgcttcaagcgctccgctctcaagggatacggttatatcctccgcgacattgtcctcctgactaccactttcagcatctggtacaactttgtgacccccgaatatatcccctccacccccgcccgcgctggtctgtgggccgtgtacaccgttcttcagggtcttttcggtactggtctctgggttattgcccatgagtgcggtcacggtgctttctccgattctcgcatcatcaacgacattactggctgggttcttcactcttccctccttgtcccctacttcagctggcaaatctcccaccgaaagcaccacaaggccactggcaacatggagcgtgacatggtcttcgttccccgaacccgcgagcagcaggctactcgtctcggaaagatgacccacgagctcgctcatcttactgaggagacccccgctttcactcttctcatgctcgtccttcagcagctcgttggctggcccaactacctcatcaccaatgttaccggccacaactaccacgagcgccagcgtgagggtcgcggcaagggcaagcataacggcctcggcggtggtgttaaccacttcgatccccgcagccctctgtacgagaacagtgacgctaagctcatcgtcctcagcgatattggtatcggtctgatggccactgctctgtacttcctcgttcagaagttcggtttctacaacatggccatctggtactttgttccctacctctgggttaaccactggctcgttgccatcaccttcctccagcacaccgaccctacccttccccactacaccaacgacgagtggaacttcgtccgtggtgccgctgctaccattgaccgtgagatgggcttcatcggccgccaccttctccacggcatcatcgagactcatgtcctccaccactacgtcagcagcatccccttctacaacgcggacgaggccaccgaggccattaagcccatcatgggcaagcactaccgggctgatgtccaggatggtcctcgtggcttcatccgcgccatgtaccgcagtgcgcgtatgtgccagtgggttgagcccagcgctggtgccgagggtgctggtaagggtgttctgttcttccgcaaccgcaacaacgtgggcaccccccccgctgttatcaagcccgttgcttaa

SEQ ID NO: 55 - protein, 477 aa, Fusarium monoliforme
MASTSALPKQNPALRRTVTSTTVTDSESAAVSPSDSPRHSASSTSLSSMSEVDIAKPKSEYGVMLDTYGNQFEVPDFTIKDIYNAIPKHCFKRSALKGYGYILRDIVLLTTTFSIWYNFVTPEYIPSTPARAGLWAVYTVLQGLFGTGLWVIAHECGHGAFSDSRIINDITGWVLHSSLLVPYFSWQISHRKHHKATGNMERDMVFVPRTREQQATRLGKMTHELAHLTEETPAFTLLMLVLQQLVGWPNYLITNVTGHNYHERQREGRGKGKHNGLGGGVNHFDPRSPLYENSDAKLIVLSDIGIGLMATALYFLVQKFGFYNMAIWYFVPYLWVNHWLVAITFLQHTDPTLPHYTNDEWNFVRGAAATIDREMGFIGRHLLHGIIETHVLHHYVSSIPFYNADEATEAIKPIMGKHYRADVQDGPRGFIRAMYRSARMCQWVEPSAGAEGAGKGVLFFRNRNNVGTPPAVIKPVA

SEQ ID NO: 56 - DNA, 1434 bp, Fusarium moniliforme
  CDS (1)..(1434): synthetic delta-12 desaturase (codon-optimized for Yarrowia lipolytica)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: WO 2005/047485
  ref <311>: PATENT FILING DATE: 2004-11-12
  ref <312>: PUBLICATION DATE: 2005-05-26
  ref <313>: RELEVANT RESIDUES IN SEQ ID NO: (1)..(1434)
  ref <302>: TITLE: DELTA-12 DESATURASES SUITABLE FOR ALTERING LEVELS OF POLYUNSATURATED FATTY ACIDS IN OLEAGINOUS YEAST
  ref <310>: PATENT DOCUMENT NUMBER: US 2005-0216975-A1
  ref <311>: PATENT FILING DATE: 2004-11-10
  ref <312>: PUBLICATION DATE: 2005-09-29
  ref <313>: RELEVANT RESIDUES IN SEQ ID NO: (1)..(1434)
atggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaa

SEQ ID NO: 57 - protein, 477 aa, Fusarium moniliforme; identical to SEQ ID NO: 55

SEQ ID NO: 58 - DNA, 828 bp, Mortierella alpina
  CDS (1)..(828): C16/18 elongase
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: US 2007-0087420-A1
  ref <311>: PATENT FILING DATE: 2005-10-19
  ref <312>: PUBLICATION DATE: 2007-04-19
  ref <313>: RELEVANT RESIDUES IN SEQ ID NO: (1)..(828)
atggagtctggacctatgcctgccgggatccccttccctgaatactatgactttttcatggactggaagacacccctggcaattgctgccacctacaccgccgctgttgggctcttcaaccccaaggttggcaaagtctcgcgcgtggtagccaagtcggctaacgccaagccggcagagcgcacgcagtccggcgccgccatgaccgcctttgtctttgtccacaaccttatcctctgcgtgtactctggaatcaccttctactacatgttcccagccatggtcaagaactttagaacacataccctccatgaggcctactgcgatacggatcagagcctgtggaacaacgcccttggctactggggctacctcttctacctttcaaagttttacgaggtcattgacaccatcatcatcatcttgaaggggcgccgctcgtccctgctccagacctaccaccacgccggcgctatgatcaccatgtggtccggcatcaactaccaggcaacgcccatttggatttttgtcgtcttcaactcgttcatccacaccatcatgtactgttactatgccttcacctcaatcggcttccaccccccaggcaagaagtacctcacctccatgcagatcacccagtttttggtcggcatcactatcgccgtctcttatctcttcgtccctggatgtatccgcacacccggtgctcagatggctgtctggatcaacgtcggatacctctttcccctcacttatctctttgtggattttgccaagcgtacttactccaagcgtagtgccatcgccgctcagaagaaggcccagtaa

SEQ ID NO: 59 - protein, 275 aa, Mortierella alpina
MESGPMPAGIPFPEYYDFFMDWKTPLAIAATYTAAVGLFNPKVGKVSRVVAKSANAKPAERTQSGAAMTAFVFVHNLILCVYSGITFYYMFPAMVKNFRTHTLHEAYCDTDQSLWNNALGYWGYLFYLSKFYEVIDTIIIILKGRRSSLLQTYHHAGAMITMWSGINYQATPIWIFVVFNSFIHTIMYCYYAFTSIGFHPPGKKYLTSMQITQFLVGITIAVSYLFVPGCIRTPGAQMAVWINVGYLFPLTYLFVDFAKRTYSKRSAIAAQKKAQ

SEQ ID NO: 60 - DNA, 828 bp, Mortierella alpina
  CDS (1)..(828): synthetic C16/18 elongase (codon-optimized for Yarrowia lipolytica)
  ref <302>: TITLE: A MORTIERELLA ALPINA C16/18 FATTY ACID ELONGASE
  ref <310>: PATENT DOCUMENT NUMBER: US 2007-0087420-A1
  ref <311>: PATENT FILING DATE: 2005-10-19
  ref <312>: PUBLICATION DATE: 2007-04-19
  ref <313>: RELEVANT RESIDUES IN SEQ ID NO: (1)..(828)
  ref <302>: TITLE: A MORTIERELLA ALPINA C16/18 FATTY ACID ELONGASE
  ref <310>: PATENT DOCUMENT NUMBER: WO 2007/046817
  ref <311>: PATENT FILING DATE: 2005-11-04
  ref <312>: PUBLICATION DATE: 2007-04-26
  ref <313>: RELEVANT RESIDUES IN SEQ ID NO: (1)..(828)
atggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaa

SEQ ID NO: 61 - protein, 275 aa, Mortierella alpina; identical to SEQ ID NO: 59

SEQ ID NO: 62 - DNA, 1209 bp, Fusarium monoliforme
  CDS (1)..(1209): delta-15 desaturase
  ref <302>: TITLE: DELTA-15 DESATURASES SUITABLE FOR ALTERING LEVELS OF POLYUNSATURATED FATTY ACIDS IN OLEAGINOUS PLANTS AND YEAST
  ref <310>: PATENT DOCUMENT NUMBER: WO 2005/047480
  ref <311>: PATENT FILING DATE: 2004-11-10
  ref <312>: PUBLICATION DATE: 2005-05-26
  ref <313>: RELEVANT RESIDUES IN SEQ ID NO: (1)..(1209)
  ref <302>: TITLE: DELTA-15 DESATURASES SUITABLE FOR ALTERING LEVELS OF POLYUNSATURATED FATTY ACIDS IN OLEAGINOUS PLANTS AND YEAST
  ref <310>: PATENT DOCUMENT NUMBER: US 2005-0132442-A1
  ref <311>: PATENT FILING DATE: 2004-11-10
  ref <312>: PUBLICATION DATE: 2005-06-16
  ref <313>: RELEVANT RESIDUES IN SEQ ID NO: (1)..(1209)
atggcgactcgacagcgaactgccaccactgttgtggtcgaggaccttcccaaggtcactcttgaggccaagtctgaacctgtgttccccgatatcaagaccatcaaggatgccattcccgcgcactgcttccagccctcgctcgtcacctcattctactacgtcttccgcgattttgccatggtctctgccctcgtctgggctgctctcacctacatccccagcatccccgaccagaccctccgcgtcgcagcttggatggtctacggcttcgtccagggtctgttctgcaccggtgtctggattctcggccatgagtgcggccacggtgctttctctctccacggaaaggtcaacaatgtgaccggctggttcctccactcgttcctcctcgtcccctacttcagctggaagtactctcaccaccgccaccaccgcttcaccggccacatggatctcgacatggctttcgtccccaagactgagcccaagccctccaagtcgctcatgattgctggcattgacgtcgccgagcttgttgaggacacccccgctgctcagatggtcaagctcatcttccaccagcttttcggatggcaggcgtacctcttcttcaacgctagctctggcaagggcagcaagcagtgggagcccaagactggcctctccaagtggttccgagtcagtcacttcgagcctaccagcgctgtcttccgccccaacgaggccatcttcatcctcatctccgatatcggtcttgctctaatgggaactgctctgtactttgcttccaagcaagttggtgtttcgaccattctcttcctctaccttgttccctacctgtgggttcaccactggctcgttgccattacctacctccaccaccaccacaccgagctccctcactacaccgctgagggctggacctacgtcaagggagctctcgccactgtcgaccgtgagtttggcttcatcggaaagcacctcttccacggtatcattgagaagcacgttgttcaccatctcttccctaagatccccttctacaaggctgacgaggccaccgaggccatcaagcccgtcattggcgaccactactgccacgacgaccgaagcttcctgggccagctgtggaccatcttcggcacgctcaagtacgtcgagcacgaccctgcccgacccggtgccatgcgatggaacaaggactag

SEQ ID NO: 63 - protein, 402 aa, Fusarium monoliforme
MATRQRTATTVVVEDLPKVTLEAKSEPVFPDIKTIKDAIPAHCFQPSLVTSFYYVFRDFAMVSALVWAALTYIPSIPDQTLRVAAWMVYGFVQGLFCTGVWILGHECGHGAFSLHGKVNNVTGWFLHSFLLVPYFSWKYSHHRHHRFTGHMDLDMAFVPKTEPKPSKSLMIAGIDVAELVEDTPAAQMVKLIFHQLFGWQAYLFFNASSGKGSKQWEPKTGLSKWFRVSHFEPTSAVFRPNEAIFILISDIGLALMGTALYFASKQVGVSTILFLYLVPYLWVHHWLVAITYLHHHHTELPHYTAEGWTYVKGALATVDREFGFIGKHLFHGIIEKHVVHHLFPKIPFYKADEATEAIKPVIGDHYCHDDRSFLGQLWTIFGTLKYVEHDPARPGAMRWNKD

SEQ ID NO: 64 - DNA, 1209 bp, Fusarium moniliforme
  CDS (1)..(1209): synthetic delta-15 desaturase (codon-optimized for Yarrowia lipolytica)
  ref <302>: TITLE: DELTA-15 DESATURASES SUITABLE FOR ALTERING LEVELS OF POLYUNSATURATED FATTY ACIDS IN OLEAGINOUS PLANTS AND YEAST
  ref <310>: PATENT DOCUMENT NUMBER: WO 2005/047480
  ref <311>: PATENT FILING DATE: 2004-11-10
  ref <312>: PUBLICATION DATE: 2005-05-26
  ref <313>: RELEVANT RESIDUES IN SEQ ID NO: (1)..(1209)
  ref <302>: TITLE: DELTA-15 DESATURASES SUITABLE FOR ALTERING LEVELS OF POLYUNSATURATED FATTY ACIDS IN OLEAGINOUS PLANTS AND YEAST
  ref <310>: PATENT DOCUMENT NUMBER: US 2005-0132442-A1
  ref <311>: PATENT FILING DATE: 2004-11-10
  ref <312>: PUBLICATION DATE: 2005-06-16
  ref <313>: RELEVANT RESIDUES IN SEQ ID NO: (1)..(1209)
atggccacccgacagcgaactgctaccactgtcgtggtcgaggacctgcccaaggttaccctcgaggccaagtccgaacctgtctttcccgacatcaagaccatcaaggatgccattcctgctcactgctttcagccctctctggtcacctccttctactatgtgttccgagactttgctatggtttctgccctcgtctgggctgcccttacctacattccctcgatccctgatcagactctgcgagtggcagcttggatggtctacggcttcgttcagggactcttctgtaccggtgtctggattctcggacacgagtgcggtcatggagccttctctctgcacggcaaggtcaacaatgtcaccggatggtttcttcattccttcctgctcgttccctacttcagctggaagtactctcatcaccgacatcaccgattcacaggtcacatggatctggacatggctttcgttcccaagaccgagcccaaaccctccaagtctctcatgattgctggcattgacgttgccgaacttgtcgaggacactcctgctgcccagatggtcaagctcatcttccatcagctgttcggatggcaggcgtacctcttcttcaacgccagctctggcaagggttccaagcagtgggagcccaagactggactctcgaagtggtttcgagtgtctcacttcgagcctaccagcgctgtcttcagacccaacgaggccatcttcattctcatctcggacatcggtcttgctctcatgggcactgcactgtactttgcttccaagcaagtcggagtttctaccattctgttcctctaccttgttccctacctgtgggtccatcactggctcgtggccattacttaccttcaccatcaccataccgaactgcctcactacaccgctgagggctggacctacgtcaagggtgcactcgccactgtggatcgagagtttggattcatcggcaagcatctctttcacggtatcattgagaagcacgttgtgcatcacttgtttcccaagattcccttctacaaggctgacgaagccaccgaggccatcaagcctgtcattggcgaccactactgtcacgacgatcggtccttcctgggtcagctgtggaccatcttcggaactctcaagtacgtggagcacgatcctgcccgacccggtgccatgcgatggaacaaggactaa

SEQ ID NO: 65 - protein, 402 aa, Fusarium moniliforme; identical to SEQ ID NO: 63

SEQ ID NO: 66 - DNA, 1449 bp, Yarrowia lipolytica
  CDS (1)..(1449): delta-9 desaturase
atggtgaaaaacgtggaccaagtggatctctcgcaggtcgacaccattgcctccggccgagatgtcaactacaaggtcaagtacacctccggcgttaagatgagccagggcgcctacgacgacaagggccgccacatttccgagcagcccttcacctgggccaactggcaccagcacatcaactggctcaacttcattctggtgattgcgctgcctctgtcgtcctttgctgccgctcccttcgtctccttcaactggaagaccgccgcgtttgctgtcggctattacatgtgcaccggtctcggtatcaccgccggctaccaccgaatgtgggcccatcgagcctacaaggccgctctgcccgttcgaatcatccttgctctgtttggaggaggagctgtcgagggctccatccgatggtgggcctcgtctcaccgagtccaccaccgatggaccgactccaacaaggacccttacgacgcccgaaagggattctggttctcccactttggctggatgctgcttgtgcccaaccccaagaacaagggccgaactgacatttctgacctcaacaacgactgggttgtccgactccagcacaagtactacgtttacgttctcgtcttcatggccattgttctgcccaccctcgtctgtggctttggctggggcgactggaagggaggtcttgtctacgccggtatcatgcgatacacctttgtgcagcaggtgactttctgtgtcaactcccttgcccactggattggagagcagcccttcgacgaccgacgaactccccgagaccacgctcttaccgccctggtcacctttggagagggctaccacaacttccaccacgagttcccctcggactaccgaaacgccctcatctggtaccagtacgaccccaccaagtggctcatctggaccctcaagcaggttggtctcgcctgggacctccagaccttctcccagaacgccatcgagcagggtctcgtgcagcagcgacagaagaagctggacaagtggcgaaacaacctcaactggggtatccccattgagcagctgcctgtcattgagtttgaggagttccaagagcaggccaagacccgagatctggttctcatttctggcattgtccacgacgtgtctgcctttgtcgagcaccaccctggtggaaaggccctcattatgagcgccgtcggcaaggacggtaccgctgtcttcaacggaggtgtctaccgacactccaacgctggccacaacctgcttgccaccatgcgagtttcggtcattcgaggcggcatggaggttgaggtgtggaagactgcccagaacgaaaagaaggaccagaacattgtctccgatgagagtggaaaccgaatccaccgagctggtctccaggccacccgggtcgagaaccccggtatgtctggcatggctgcttag

SEQ ID NO: 67 - protein, 482 aa, Yarrowia lipolytica
MVKNVDQVDLSQVDTIASGRDVNYKVKYTSGVKMSQGAYDDKGRHISEQPFTWANWHQHINWLNFILVIALPLSSFAAAPFVSFNWKTAAFAVGYYMCTGLGITAGYHRMWAHRAYKAALPVRIILALFGGGAVEGSIRWWASSHRVHHRWTDSNKDPYDARKGFWFSHFGWMLLVPNPKNKGRTDISDLNNDWVVRLQHKYYVYVLVFMAIVLPTLVCGFGWGDWKGGLVYAGIMRYTFVQQVTFCVNSLAHWIGEQPFDDRRTPRDHALTALVTFGEGYHNFHHEFPSDYRNALIWYQYDPTKWLIWTLKQVGLAWDLQTFSQNAIEQGLVQQRQKKLDKWRNNLNWGIPIEQLPVIEFEEFQEQAKTRDLVLISGIVHDVSAFVEHHPGGKALIMSAVGKDGTAVFNGGVYRHSNAGHNLLATMRVSVIRGGMEVEVWKTAQNEKKDQNIVSDESGNRIHRAGLQATRVENPGMSGMAA

SEQ ID NO: 68 - DNA, 1185 bp, Yarrowia lipolytica
  CDS (1)..(1185): diacylglycerol cholinephosphotransferase (YlCPT1)
  ref <302>: TITLE: HIGH EICOSAPENTAENOIC ACID PRODUCING STRAINS OF
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(1185)
  ref <302>: TITLE: HIGH EICOSAPENTAENOIC ACID PRODUCING STRAINS OF
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(1185)
atgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgttgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctgctgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgaatccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctcccttcccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagactgagtaa

SEQ ID NO: 69 - protein, 394 aa, Yarrowia lipolytica
MGVFIKQEQLPALKKYKYSAEDHSFISNNILRPFWRQFVKIFPLWMAPNMVTLLGFFFVIVNFITMLIVDPTHDREPPRWVYLTYALGLFLYQTFDACDGSHARRTGQSGPLGELFDHCVDAMNTSLILTVVVSTTHMGYNMKLLIVQIAALGNFYLSTWETYHTGTLYLSGFSGPVEGILILVALFVLTFFTGPNVYALTVYEALPESITSLLPASFLDVTITQIYIGFGVLGMVFNIYGACGNVIKYYNNKGKSALPAILGIAPFGIFYVGVFAWAHVAPLLLSKYAIVYLFAIGAAFAMQVGQMILAHLVLAPFPHWNVLLFFPFVGLAVHYIAPVFGWDADIVSVNTLFTCFGATLSIYAFFVLEIIDEITNYLDIWCLRIKYPQEKKTE

SEQ ID NO: 70 - DNA, 4844 bp, Yarrowia lipolytica (GenBank Accession No. AJ306421)
  CDS (1195)..(2049): Ura3
acagtatcattaggaaaggggtgacactgcactattggtttgcttctgatgatacgtatgaatacgatggtatcttgatacagagtcttgcatacattaatttcgaaactagagcacagcaacagctcccaaatgagcattcccctgaagcccatcaaaactgcaccacaaatttgatcccatattaccattttaaagcaattgttaacaagatactactgtagaaaactgattaaacattcgtaacttgcctgtggctcgacttacagccaaatgttcgcggcaaaatttgaatattttgcacacttattgtcccaaaaccaaataatgccaacaaaatccgatatagtgtaggggctatcacatcacgctctcatcaagaatacttcttgagaaccgtggagaccggggttcgattccccgtatcggagtgtttattttttgctcaaccataccctggggtgtgttctgtggagcattctcacttttggtaaacgacattgcttcaagtgcagcggaatcaaaaagtataaagtgggcagcgagtatacctgtacagactgtaggcgataactcaatccaattaccccccacaacatgactggccaaactgatctcaagactttattgaaatcagcaacaccgattctcaatgaaggcacatacttcttctgcaacattcacttgacgcctaaagttggtgagaaatggaccgacaagacatattctgctatccacggactgttgcctgtgtcggtggctacaatacgtgagtcagaagggctgacggtggtggttcccaaggaaaaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagaagccaagatactatcaagacatgtgtcgcaacttcaaggaggaccaagctctgtacaccgagaaacaggcctttgtcgacgaagctctaaagctgaaacgggacatcgaaaagttggagaagtcaatctggaaactacacgtagaaaacagacaccatctccaacaagtacaggacttcaaatttgcactgaagacattctgtgggtggagccataagtaacaatcgcctgctccaggaacttaaaaaagaggcattataggccccttcatctgaatattctttgagtaccaactgccgccaactccccaatcgttaattagtgttatctattctatctatgctattagcacatatttatcatgtgctgctgttatgtacgggttcaatatacaaatgcttagtcctcaaacaccttcataggtgggtcgtcttcctggccaaatcgaattctcatgatttcaaacacgaacagaccgatagacgtagacggaagcgcactgagggtcgtccagccacaaccatggtataggtatctgggccaactcaaccgcagaccctttcggatgttattggctgtatgcagagtctcaacgtaggctcggtagtagagatggatacccgggaagattctgtatctaagagtagtaaaacatctaatagaaaagttgacggtcttactccatcccttaccaaacttcacaagaagtgaatgcgttctgggaagagtctcctccagcgtttcagacagttccaccataagagggtttctgtggtgaatccgacgctcgtagcatagaaatgttgactggaaaggagaggcgggactggcctgatgttttattcgctctccaagtttgttctgtgtcttttgctccttggatcggttagcttccagttgttttcttgcgtcaatgaggtcttgagtatcgagacgagtcaggtagatgccctgcagcttctgaagaggaaactgaaccacatgcagtgagatggtggctgctgctccagctacaaggatgctgaaaggtgctaggaccttgttgacgatgctttttccattctcatcaaagcctgaaggatgttccttgagacgatcagcatacagccacttggcataggacctgtaccacgatcccttaaccatttcgaacgtggcaaaaaagaccccaaaacccagactctctttgacaactgacaacgtaaagccagcaaagacacctggtgcacctgtttggcgcaacttctccattccataggaccacatagagggcaactgtttggtcttgagcacttctgctatcgaagaacgcctgtagatggcgtcgattggtgctgcagctactgcctgggctgctccagcgactgctccggcacaaaacgtctgtttgaacgtgtatcgatgaggcatgagttcatcgatgatgtatttcacatgcgagccgtccattccctgggtatcataccatgatttccttagcagcagttgtcgttggtgttcgtcttcttcatcctccttttgtcggtctttctctgatttgaataatggtagacatcccagatatgtggagtacaataccagtcctacggccgagttcgccaataaggggggcagcaattgatttggaataaaaccccagccatgctgtttgactgcgttggcaatcagagccggactgctgtgtgttttgaagctccaaggtttgtcgctgtttggagacagcgcccgtggaagcgctaagtagtcgactctggtaggtcgaaagagcttgacaggcacacggatgtaaaatgtgaagagctgggatgcgagcgcccgagtaccggccgtcgtagctccaataatccgggccgagcttggtttccatgcttcgttattgttttcgtgcggttcggtgaattccggaacctcgggcagaaatcccggaacgtcgccgggctcgattttctgcatgaggcctagaaacactctccagtgtcgcgggacgtgaggaacgggcttctatctgctgagcgatatcaggtactggtcgtgcttgcggttgtccagagatccaaaacttttgcgatgcgtcagggacgcacagtttaccgacaacggaggagtgcaaaacgtgggggaacagggcagtttgtgtgggtgggtcggcgagtccgaatgatgattttgtatcgttacagattgcgtggggtggagattaatatggctgctcgaaaattgctcgtgtcgcgttactgagaggcagagtacatgtacgcgagctctcctgtgtctactccttcacctctttaatgttgctgtacatatacgcggtatgatagatgtggtcaggtggtggatttgggaatgaaggtcggtttgggctcggtagtggtaatgagtgtcatgggtgaggcttaagtggcgagagatc

SEQ ID NO: 71 - protein, 284 aa, Yarrowia lipolytica (GenBank Accession No. AJ306421)
MPSYEARANVHKSAFAARVLKLVAAKKTNLCASLDVTTTKELIELADKVGPYVCMIKTHIDIIDDFTYAGTVLPLKELALKHGFFLFEDRKFADIGNTVKHQYRCHRIAEWSDITNAHGVPGTGIIAGLRAGAEETVSEQKKEDVSDYENSQYKEFLVPSPNEKLARGLLMLAELSCKGSLATGEYSKQTIELARSDPEFVVGFIAQNRPKGDSEDWLILTPGVGLDDKGDALGQQYRTVEDVMSTGTDIIIVGRGLYGQNRDPIEEAKRYQKAGWEAYQKINC

SEQ ID NO: 72 - DNA, 5194 bp, Yarrowia lipolytica (GenBank Accession No. AF260230)
  CDS (798)..(2015): Leu2
tcgacaccatatcatataaaactaacaatgcattgcttattacgaagactacccgttgctatctccacaccgttatctccacggtccaaaggctgctcaatgtgctgcatacgtaacgtggggtgcaaccttgagcacatagtacttttccgaaaaccggcgataattaagtgtgcactccaacttttcacactgagcgtaaaatgtggagaagaaatcggcactaaaaagtcaggtagactggaaaatgcgccatgaaatgaatatctcttgctacagtaatgcccagcatcgaggggtattgtgtcaccaacactatagtggcagctgaagcgctcgtgattgtagtatgagtctttattggtgatgggaagagttcactcaatattctcgttactgccaaaacaccacggtaatcggccagacaccatggatgtagatcaccaagcctgtgaatgttattcgagctaaaatgcacatggttggtgaaaggagtagttgctgtcgaattccgtcgtcgcctgagtcatcatttatttaccagttggccacaaacccttgacgatctcgtatgtcccctccgacatactcccggccggctggggtacgttcgatagcgctatcggcatcgacaaggtttgggtccctagccgataccgcactacctgagtcacaatcttcggaggtttagtcttccacatagcacgggcaaaagtgcgtatatatacaagagcgtttgccagccacagattttcactccacacaccacatcacacatacaaccacacacatccacaatggaacccgaaactaagaagaccaagactgactccaagaagattgttcttctcggcggcgacttctgtggccccgaggtgattgccgaggccgtcaaggtgctcaagtctgttgctgaggcctccggcaccgagtttgtgtttgaggaccgactcattggaggagctgccattgagaaggagggcgagcccatcaccgacgctactctcgacatctgccgaaaggctgactctattatgctcggtgctgtcggaggcgctgccaacaccgtatggaccactcccgacggacgaaccgacgtgcgacccgagcagggtctcctcaagctgcgaaaggacctgaacctgtacgccaacctgcgaccctgccagctgctgtcgcccaagctcgccgatctctcccccatccgaaacgttgagggcaccgacttcatcattgtccgagagctcgtcggaggtatctactttggagagcgaaaggaggatgacggatctggcgtcgcttccgacaccgagacctactccgttcctgaggttgagcgaattgcccgaatggccgccttcctggcccttcagcacaacccccctcttcccgtgtggtctcttgacaaggccaacgtgctggcctcctctcgactttggcgaaagactgtcactcgagtcctcaaggacgaattcccccagctcgagctcaaccaccagctgatcgactcggccgccatgatcctcatcaagcagccctccaagatgaatggtatcatcatcaccaccaacatgtttggcgatatcatctccgacgaggcctccgtcatccccggttctctgggtctgctgccctccgcctctctggcttctctgcccgacaccaacgaggcgttcggtctgtacgagccctgtcacggatctgcccccgatctcggcaagcagaaggtcaaccccattgccaccattctgtctgccgccatgatgctcaagttctctcttaacatgaagcccgccggtgacgctgttgaggctgccgtcaaggagtccgtcgaggctggtatcactaccgccgatatcggaggctcttcctccacctccgaggtcggagacttgttgccaacaaggtcaaggagctgctcaagaaggagtaagtcgtttctacgacgcattgatggaaggagcaaactgacgcgcctgcgggttggtctaccggcagggtccgctagtgtataagactctataaaaagggccctgccctgctaatgaaatgatgatttataatttaccggtgtagcaaccttgactagaagaagcagattgggtgtgtttgtagtggaggacagtggtacgttttggaaacagtcttcttgaaagtgtcttgtctacagtatattcactcataacctcaatagccaagggtgtagtcggtttattaaaggaagggagttgtggctgatgtggatagatatctttaagctggcgactgcacccaacgagtgtggtggtagcttgttactgtatattcggtaagatatattttgtggggttttagtggtgtttggtaggttagtgcttggtatatgagttgtaggcatgacaatttggaaaggggtggactttgggaatattgtgggatttcaataccttagtttgtacagggtaattgttacaaatgatacaaagaactgtatttcttttcatttgttttaattggttgtatatcaagtccgttagacgagctcagtgccatggcttttggcactgtatttcatttttagaggtacactacattcagtgaggtatggtaaggttgagggcataatgaaggcaccttgtactgacagtcacagacctctcaccgagaattttatgagatatactcgggttcattttaggctccgattcgattcaaattattactgtcgaaatcggttgagcatccgttgatttccgaacagatctactcatcgcttctctccattatcctaatgtttgatccatttagagtgcaagcaccaaagtcggttcagtacagtaaccatactgcaacaaccaagttgtcaaggctgtctccctcggctttgtaacgccaggcgtttctgttttcgtccactgcaaccatgcagtggcacgacagaggcgtgtggtctgtacagtgcattcagttcgtttttgtatccttacgtggcctgtcagattgaaagatttttcagatcaccccttcgctggttctttgttatgatacgtatgagatgagtagagctatggggtgtgtgttttaggaccctttctcgacgactaaatttgctatttccccacattaaaacaactaacctcgataaagtggacttcacgtgtgtaagaaggctacaagagcgagtacatacgagatatgccgtgtgcttcttgtactgcctgttgcactgcttgttgtacttcctcgtactgcttgttgcactgtatgtgggggtggtgttgttgtactgtagacgtattgaccttccttgtacggctccttgtatggctcgtatttatatgcgtctctttttttgttcttggctctacccctaatactcgtccttacatgacgctttagttgacgtcttgtgggtgtctatctcatcgggtttagctggtcatccccctgcaccaccgagcaacaatagctaccggcatgtgagacactggaggcagaggcagagaaaaagcaaagggtaaagtgagcaaggagtttcacggatttggcttaataggatgtggcgttccactgatgacttttgtctctctagagcggttgagaatagtttggcactggtctttggcgttggtagcgttctcacacactgtccaagttgacgtcagcggccgcagcctctgtttcagcctcaaaacaggttctattgttgccattgttaccctgtctcctatctgatgctctcccttgtatcgagcaaataagacaatttaacgtgcatacaaagggctattgttggctcgagttgattggccagtttggggcaacaatggtagctgatccagggtccttgagttcaaaatgggggggaaaccatgtacccagcacgacaagtttctctcgggtgcccccatcaactctttccacaaatacatccaagattgctgtggatgtggctgcgtgggagatgggagttgcagtgtggttgccgaaagcggcagcgatgtgcatcttgtggcaagagagttaaaaaaaaaaaagatagaaaaaaaagggttacggcgaaaagaaatattaagtggtccgactgggtcgtgtggtgcactttgttaggaaagacggaatgtaaatcagtcgtcagtttgggtgtttaaaccggtgcagagagaacatcaactctcacgccccctcccctccgcagttgatgtctgtccaaaccattaaccccttgataaattgtcattttgataacaagatatgccactaatgctgtaaaccaaattcgacatctttattcagacacctgtccgttgtccacaaaaatgcttttaccccactgtaaggacaaaacgtagagtgtaccagaggttgactttctgtctttaagctcagacttggtgtggagaaggacaaggttccagcactctgacatgaccccagcatcattctaatctcttttggatcaagtttaacatactcttggaatatctatagcacccagagaccttgacttctgcctcaacactcgccccttcgaccatgggaaacgcagaatccaaaccccggcgcaagcagcggtccacgggcagcgaaagctcccaaaccagcacccagtcgcttccggcacagactcaaacacaaacacattccgccgccatcaaagcctcctctcgccccaaacgaacacagagacccgcctctgcgcaccccgcagtacccatccccacaaagtcttttcaggagaaatcagctctcatgaaccgacttgttaccccggcccagccctgctctgctcgggttacttacatcaagcctgtcaccgtgtctcctgacgacgaaaaggacgccgatattggccccaccgcaaaagctccggtggttgttgcgacagaaatcccttccattctgacgccagaagactcgcccaaatacctggagccctctgaggcagcgcccttcggtaagctccacgtgggagcccaagtcgccgagggtctccagggaaaccgacgagactcagataatcgcaacattgtcaactccaagatccagctgcgagatgactcgcccgcagaagacgacgaagacgactcagaagactactactacaaaaacaacctcacctacggcctcaaacagctcaagctaggcaccgatgtcgccaacatgaacattgaggtggtgggacaagacgccgtctcaaagccgctgtcgcggg

SEQ ID NO: 73 - protein, 405 aa, Yarrowia lipolytica (GenBank Accession No. AF260230)
MEPETKKTKTDSKKIVLLGGDFCGPEVIAEAVKVLKSVAEASGTEFVFEDRLIGGAAIEKEGEPITDATLDICRKADSIMLGAVGGAANTVWTTPDGRTDVRPEQGLLKLRKDLNLYANLRPCQLLSPKLADLSPIRNVEGTDFIIVRELVGGIYFGERKEDDGSGVASDTETYSVPEVERIARMAAFLALQHNPPLPVWSLDKANVLASSRLWRKTVTRVLKDEFPQLELNHQLIDSAAMILIKQPSKMNGIIITTNMFGDIISDEASVIPGSLGLLPSASLASLPDTNEAFGLYEPCHGSAPDLGKQKVNPIATILSAAMMLKFSLNMKPAGDAVEAAVKESVEAGITTADIGGSSSTSEVGDLLPTRSRSCSRRSKSFLRRIDGRSKLTRLRVGLPAGSASV

SEQ ID NO: 74 - DNA, 2569 bp, Yarrowia lipolytica (GenBank Accession No. M34929)
  misc_feature: Lys5 coding sequence is complement of 655..1764
gagtctggaacggtccctcttctcagaattgtgaacgaaaggaacaggttcaacgaacagaacagattccatagccacacctttgcctatggcttcacaaccgaaggcaattcgagaggtcgcgcttatggaatcgactcgtataaagctgaagggaaagggagacgttccgagcgctcagatgcaatagtcgtccagctaatgtggattcaaaaacaaccccaacagtaatcttgaaaatttgaacggatcaatctgaacactcttgctccaggtcattcttctaacgcacatccccagagtctagagggagttgtgttgtgaacatcctaataaacaatgcaatggattcgggatatcttctgtctcgccccctactcgatgtcgagtaaaccgatcaccaactaacaatactcctccgcgttctgccattgactctcaaacagacatcgctatcaacggaacagcatattttagcttcttaggacaataaatattgataatgccggctctccctcggtatattaagcaatccattcatacactcattcatcaggttaattttatatatataatttgtctattcaaacaccgtaaattactggtaccatcatctcctccttttcaaatacacgtctatttgcattaatgaaattactcgccaattcgcagaacgtgtttgtcgaacagagccttagctcgggtccagacaggagcagtgtctcgctgaggaagctgcaggagagaaggcagcagagcctcagaaaaggcctcggaagcctctcgcggcagaagagagggcaggtggtcgatcgagcacacggacagcttggggccagcagtggtctcaacaggcacggtgggatggtcgaacgtggtagcaattgtgtacacggggacagggttgtgggggttggtggtgtcagcagagacgtcgacaatgacactgagctttcgggtctccttgttgagcagatcgtagttgatgaaaggaggaatgggctgagacaggtagatgcagttgatgaagatatccgcgtcagcaatctcttggaagggtccacccttcttggtctcgttcatgtcccatcgaatgatgttctcttcggggataccgacctttcgggccagatcaatggcaccggatccacatcggccaagagcaccaatcaccaggacggtagggagcttggagcccttctcaacagcagcggcaagatccttcttaatcttgtcgacaagctcggtctcattgggataggcagagacaccgggcaggttttcgctgtcggggtgggtctgctggaaggcccaagtctcgacaccgatggcggcaccggcgaatccagcgtggaagccaaaggcggcaactcgtcgtccattgtcatcctccaggaactcaaggtcgtacagagttccgtttcctgcggggaatcggctcagaacgtccttccatccgccctgatccttgtagcagtgagcaaactggatgtgctcgtgagacagagggaaagattcctcaggcagctccttaagaccaataatcattcggtcctcgggggcagagacccaagagccctcctcgacaagagtggctccgacatcgacaaactcctggtcgtcgaagattcgaaggggagacttctccacaaagacctcgaatccagcatcaagcagctttcgggtggtagtaggcgtgagagcagatcggtgctcgagaggcttggtctcggctcggagatggagcttcactggtgcggtcattgtgtctgtgttgttgtatgtggtgaagtgacaatggatggtgtgtcgtatcaggctggggaacaattgtgcttaagtatgctgcagttgagtaagagtcatcgatccaccaaaataaagtttgccattagggttggagagagagatggtggctggaagaattaaatgacatcaagctgaggattgtgggtgtgcaataacacatgttaggggtgacctgtggctcgaaatctgataattattttgtaactttatgattattcttagattttttaatattcctctatataacacataagtagctgtcgtctagttgttcatagcctgactcctgcaatagattagtgcagagtgattttgtgcaattgagagccacggttgagtcaagtgactttgtgtgtgaagtcatcttacgtttcaagtctcacaggttactcaattggttggttgtctgccctttacagatatttacagtacctgagcgtaaagtcgttcatccacggaatgactgttcctgtcacgcagtcatgatcatggatgtggctggtcaggaaccattttggataggagacttagggattggactattattgaaaaaactgagccgaatatgatatagttctatttgaatgcagaacttctgatggtcaattcacttatttcaggcatatcggtcatggtggcagctgccacgatgttatctcgttggaaacctcgtccgccattaaccggaacatgcttctagaagatgagaatacagcatgtacttgtacaagattctcggcattgatggtctcaggcatgc

SEQ ID NO: 75 - protein, 677 aa, Yarrowia lipolytica (GenBank Accession No. XP_504703)
  MISC_FEATURE (1)..(677): Pox1
MAKERGKTQFTVRDVTNFLNGGEEETQIVEKIMSSIERDPVLSVTADYDCNLQQARKQTMERVAALSPYLVTDTEKLSLWRAQLHGMVDMSTRTRLSIHNNLFIGSIRGSGTPEQFKYWVKKGAVAVKQFYGCFAMTELGHGSNLKGLETTATYDQDSDQFIINTPHIGATKWWIGGAAHTSTHCVCFAKLIVHGKDYGTRNFVVPLRNVHDHSLKVGVSIGDIGKKMGRDGVDNGWIQFTNVRIPRQNMLMRYAKVSDTGVVTKPALDQLTYGALIRGRVSMIADSFHVSKRFLTIALRYACVRRQFGTSGDTKETKIIDYPYHQRRLLPLLAYCYAMKMGADEAQKTWIETTDRILALNPNDPAQKNDLEKAVTDTKELFAASAGMKAFTTWGCAKIIDECRQACGGHGYSGYNGFGQGYADWVVQCTWEGDNNVLCLSMGRGLVQSALQILAGKHVGASIQYVGDKSKISQNGQGTPREQLLSPEFLVEAFRTASRNNILRTTDKYQELVKTLNPDQAFEELSQQRFQCARIHTRQHLISSFYARIATAKDDIKPHLLKLANLFALWSIEEDTGIFLRENILTPGDIDLINSLVDELCVAVRDQVIGLTDAFGLSDFFINAPIGSYDGNVYEKYFAKVNQQNPATNPRPPYYESTLKPFLFREEEDDEICDLDE

SEQ ID NO: 76 - protein, 700 aa, Yarrowia lipolytica (GenBank Accession No. XP_505264)
  MISC_FEATURE (1)..(700): Pox2
MNPNNTGTIEINGKEYNTFTEPPVAMAQERAKTSFPVREMTYFLDGGEKNTLKNEQIMEEIERDPLFNNDNYYDLNKEQIRELTMERVAKLSLFVRDQPEDDIKKRFALIGIADMGTYTRLGVHYGLFFGAVRGTGTAEQFGHWISKGAGDLRKFYGCFSMTELGHGSNLAGLETTAIYDEETDEFIINTPHIAATKWWIGGAAHTATHTVVFARLIVKGKDYGVKTFVVQLRNINDHSLKVGISIGDIGKKMGRDGIDNGWIQFTNVRIPRQNLLMKYTKVDREGNVTQPPLAQLTYGSLITGRVSMASDSHQVGKRFITIALRYACIRRQFSTTPGQPETKIIDYPYHQRRLLPLLAYVYALKMTADEVGALFSRTMLKMDDLKPDDKAGLNEVVSDVKELFSVSAGLKAFSTWACADVIDKTRQACGGHGYSGYNGFGQAYADWVVQCTWEGDNNILTLSAGRALIQSAVALRKGEPVGNAVSYLKRYKDLANAKLNGRSLTDPKVLVEAWEVAAGNIINRATDQYEKLIGEGLNADQAFEVLSQQRFQAAKVHTRRHLIAAFFSRIDTEAGEAIKQPLLNLALLFALWSIEEDSGLFLREGFLEPKDIDTVTELVNKYCTTVREEVIGYTDAFNLSDYFINAPIGCYDGDAYRHYFQKVNEQNPARDPRPPYYASTLKPFLFREEEDDDICELDEE

SEQ ID NO: 77 - protein, 700 aa, Yarrowia lipolytica (GenBank Accession No. XP_503244)
  MISC_FEATURE (1)..(700): Pox3
MISPNLTANVEIDGKQYNTFTEPPKALAGERAKVKFPIKDMTEFLHGGEENVTMIERLMTELERDPVLNVSGDYDMPKEQLRETAVARIAALSGHWKKDTEKEALLRSQLHGIVDMGTRIRLGVHTGLFMGAIRGSGTKEQYDYWVRKGAADVKGFYGCFAMTELGHGSNVAGLETTATYIQDTDEFIINTPNTGATKWWIGGAAHSATHTACFARLLVDGKDYGVKIFVVQLRDVSSHSLMPGIALGDIGKKMGRDAIDNGWIQFTNVRIPRQNMLMKYAKVSSTGKVSQPPLAQLTYGALIGGRVTMIADSFFVSQRFITIALRYACVRRQFGTTPGQPETKIIDYPYHQRRLLPLLAFTYAMKMAADQSQIQYDQTTDLLQTIDPKDKGALGKAIVDLKELFASSAGLKAFTTWTCANIIDQCRQACGGHGYSGYNGFGQAYADWVVQCTWEGDNNVLCLSMGRGLIQSCLGHRKGKPLGSSVGYLANKGLEQATLSGRDLKDPKVLIEAWEKVANGAIQRATDKFVELTKGGLSPDQAFEELSQQRFQCAKIHTRKHLVTAFYERINASAKADVKPYLINLANLFTLWSIEEDSGLFLREGFLQPKDIDQVTELVNHYCKEVRDQVAGYTDAFGLSDWFINAPIGNYDGDVYKHYFAKVNQQNPAQNPRPPYYESTLRPFLFREDEDDDICELDEE

SEQ ID NO: 78 - protein, 701 aa, Yarrowia lipolytica (GenBank Accession No. XP_504475)
  MISC_FEATURE (1)..(701): Pox4
MITPNPANDIVHDGKLYDTFTEPPKLMAQERAQLDFDPRDITYFLDGSKEETELLESLMLMYERDPLFNNQNEYDESFETLRERSVKRIFQLSKSIAMDPEPMSFRKIGFLGILDMGTYARLGVHYALFCNSIRGQGTPDQLMYWLDQGAMVIKGFYGCFAMTEMGHGSNLSRLETIATFDKETDEFIINTPHVGATKWWIGGAAHTATHTLAFARLQVDGKDYGVKSFVVPLRNLDDHSLRPGIATGDIGKKMGRDAVDNGWIQFTNVRVPRNYMLMKHTKVLRDGTVKQPPLAQLTYGSLITGRVQMTTDSHNVSKKFLTIALRYATIRRQFSSTPGEPETRLIDYLYHQRRLLPLMAYSYAMKLAGDHVRELFFASQEKAESLKEDDKAGVESYVQDIKELFSVSAGLKAATTWACADIIDKARQACGGHGYSAYNGFGQAFQDWVVQCTWEGDNTVLTLSAGRALIQSALVYRKEGKLGNATKYLSRSKELANAKRNGRSLEDPKLLVEAWEAVSAGAINAATDAYEELSKQGVSVDECFEQVSQERFQAARIHTRRALIEAFYSRIATADEKVKPHLIPLANLFALWSIEEDSALFLAEGYFEPEDIIEVTSLVNKYCGIVRKNVIGYTDAFNLSDYFINAAIGRYDGDVYKNYFEKVKQQYPPEGGKPHYYEDVMKPFLHRERIPDVPMEPEDIQ

SEQ ID NO: 79 - protein, 699 aa, Yarrowia lipolytica (GenBank Accession No. XP_502199)
  MISC_FEATURE (1)..(699): Pox5
MNNNPTNVILGGKEYDTFTEPPAQMELERAKTQFKVRDVTNFLTGSEQETLLTERIMREIERDPVLNVAGDYDADLPTKRRQAVERIGALARYLPKDSEKEAILRGQLHGIVDMGTRTRIAVHYGLFMGAIRGSGTKEQYDYWVAKGAATLHKFYGCFAMTELGHGSNVAGLETTATLDKDTDEFIINTPNSGATKWWIGGAAHSATHTACLARLIVDGKDYGVKIFIVQLRDLNSHSLLNGIAIGDIGKKMGRDAIDNGWIQFTDVRIPRQNMLMRYDRVSRDGEVTTSELAQLTYGALLSGRVTMIAESHLLSARFLTIALRYACIRRQFGAVPDKPETKLIDYPYHQRRLLPLLAYTYAMKMGADEAQQQYNSSFGALLKLNPVKDAEKFAVATADLKALFASSAGMKAFTTWAAAKIIDECRQACGGHGYSGYNGFGQAYADWVVQCTWEGDNNVLCLSMGRSLIQSCIAMRKKKGHVGKSVEYLQRRDELQNARVDNKPLTDPAVLITAWEKVACEAINRATDSFIKLTQEGLSPDQAFEELSQQRFECARIHTRKHLITSFYARISKAKARVKPHLTVLANLFAVWSIEEDSGLFLREGCFEPAEMDEITALVDELCCEAREQVIGFTDAFNLSDFFINAPIGRFDGDAYKHYMDEVKAANNPRNTHAPYYETKLRPFLFRPDEDEEICDLDE

SEQ ID NO: 80 - DNA, 3278 bp, Yarrowia lipolytica (GenBank Accession No. Z50020)
  CDS (847)..(2307): Lip1
ctgcagctcttccctgccatccgaatcatcgagaatggtctcttcacccgatcaggcaagtacaactctaccatcaagtggcagaagaacattttccggttcttccttgtgtttgtcaccgcctttgttgcatggggaggtgccgacgatctcgatcggttcgtcgctctcaccggatcgtttgcatgtgtgcctctggtgtacatttaccctcctcttttgcattacaagggtgttgctcgaggcaccacggctcgaaccgccgatgtctgtattttcatctttggtctgtgtgccatgggctacaccactgccaacacagttggttcttggattggcggaaactagatgataccatccgtgccgcttttcatcaagcaggtgcatagacttaaatatttagtaaatgcacagattatattggcctgtgtaagagtgtatatgtgggggatgttcgcattatcgaggtcattgctctccatgcaacggaagtcggaaccagtcttactacccgttgaagatgcacatctttgcattagtgtggaaaggtgcatatagcggaatgtttccgcccattcataacaagtgttctatagatggggtaatacagagtgagtttatgatatgatcttgacaaggcatagaaccgctcttctagtgaagttgacttccgacaacatccattgctcgattcaggcgagggagactgtggtttcagttcaatcaatgccaatgtaacatagtgtccaaagcgctttagtttagcgcgttctggcctgtgtgattatataaggagggagatgttctgattgttgtctactaactatcaattccggtcaagaaatcatgtctgtcacatcaacttctctcaatggaaccttcaacggtatctctgaagacggcatcgagatcttcaagggtatcaagtacgcaaacagacggtatcgatgggcgtatgccgagcgaatcgacgactacgataatggcgttttcgactgcactcaggaaggcatggcttgtccgcaagtacttcctttcgactacaacattgaaaaggggcccaaggagatgccttttgatgagtttgaatgctccaatctcatgatcactcgaccccaaggcgctacaaatcttcctgtgtttgtatggatccacggaggaggaaatctggctggaaatgggtactgttccgatcacaaccccgttcctttcgtcaagcactccattgtggctggaagacccgttcttcatgtgatgatcgagtaccgtctcagtgcctttgggtatcttgctgttccggacacaaatggcaactgggttggcaattggggtgcccgagaccaatacacagccttgcaatggatctccaaacatatcgtggagtttggaggcgacccttcccagatcaccattggaggagagtccgcaggaagtattggacttcacgctctcatggtgcacgagagtatgaagcccaaggaagagtgtattatccacaatgttatcctctcgtcagggaccatggatcgaatgggtacggggacaatttcagaggatgcttttaagcccatctatgacggtatcaaaactctggttggagatatcaacacctgttctgcggacgagctgttggaggctcaaatcaaagccggcctcgacctcggcttttacctccaagacgacttcttccctccagactggagaaacgtgcggttcaaagtctctcgggttttactctcggacgtgattgtggatggaaccaacttcaagaacaagatcaatccagcggtacgagtaactccagagaacgactttgaccacaaggtcttcaagctctacaacatatctaccgaagatacatgggaggactaccactataagatgatgctatttaagggagacgagacctttattcgtggaaaccagcagctggaacttctgtttgagcaggaaaatatccccgtctggagacagttgttcgaccagattcatccaaatgaccccagtcgtctctgccaccatgccgtggatctctattacatgtgggacaactgggagatgcctgaagataaacatgcagtggcccgtcagtaccaggacactctgaccaagtttgtttacggacaagacccctggccggtcgacaagctccattatgtccacgataaccagtttgagatcctagacaagtctcagtttggcgacttccgcaacgttccagccctcaagtttctcttgggattctcagccgaagagcttggagaactcacgaaaaagtacactggagagggtcactacacgttgtagggttcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggacgtgactacaacagcctgcctggtcaaccacatcattcatgttgctgatgatcttctgaatcagctgaagagggtactctgtctcaatcagatcaccaaatttggggtgcagtagggcacatgatcgaagcatgagtgcagtagtagcacaataagtcattcgagcaaggtagagagtactcgacgacagaatctgcattgtgtagagctccgagaatccctccagggatgttcgcaccgcatcggcagtggcatggcactattgatcactgcgggggtcagtttgagatcgaagatgttcagaccaaactcggagaagggcgttcgaggaacagtgggtgacacgttcgtcaacagagatagttcatgcagagagatcttgagagaagatttgaacaactcgagaacgtgatcaattgggaaccctcgcttgtcaaaggtgaacacctcgtcgattcgacggtcgaaatgcttgaccagccgctgagtacgttcatcattgatatccagaggcttcttgtaatcctcacttctaagcatggccatcatatcttccaactccttgaacactttggccagcttggcacatctgatctcattaatggttgaatcaggtgtggaaaagaggtcacagcattctgcag

SEQ ID NO: 81 - protein, 486 aa, Yarrowia lipolytica (GenBank Accession No. Z50020)
MSVTSTSLNGTFNGISEDGIEIFKGIKYANRRYRWAYAERIDDYDNGVFDCTQEGMACPQVLPFDYNIEKGPKEMPFDEFECSNLMITRPQGATNLPVFVWIHGGGNLAGNGYCSDHNPVPFVKHSIVAGRPVLHVMIEYRLSAFGYLAVPDTNGNWVGNWGARDQYTALQWISKHIVEFGGDPSQITIGGESAGSIGLHALMVHESMKPKEECIIHNVILSSGTMDRMGTGTISEDAFKPIYDGIKTLVGDINTCSADELLEAQIKAGLDLGFYLQDDFFPPDWRNVRFKVSRVLLSDVIVDGTNFKNKINPAVRVTPENDFDHKVFKLYNISTEDTWEDYHYKMMLFKGDETFIRGNQQLELLFEQENIPVWRQLFDQIHPNDPSRLCHHAVDLYYMWDNWEMPEDKHAVARQYQDTLTKFVYGQDPWPVDKLHYVHDNQFEILDKSQFGDFRNVPALKFLLGFSAEELGELTKKYTGEGHYTL

SEQ ID NO: 82 - DNA, 5304 bp, Yarrowia lipolytica (GenBank Accession No. AJ012632)
  CDS (3737)..(4741): Lip2
gatatcggtagcaaacagacacgaagaagaggccttggagaatttggaaacaacatccattcgtgctccttgtttctgcttgccatgcaaatgcaacagggggataccgggctgcagagttcggaaggtctcgtagacgtatcgcacctgttttgatgaactgaagaaaacgatgatcttgaacttggtgtgtgttctcaggaaaccccacagtgtgtccagcttgtcttgcagctccacgcagacatagttctgttcgaggttcttgggtgtgctggaagtggtgtccgggttggcggagatgtacttggggtcggcgagtgacaaacgggccagatcactgacgctcttggtctgtgttgcgctgaaaagcagagtctgtctgtccacaggcaggttttccaaaatggcatccatggtcttcttgaaacccatatcgaggattcgatcggcctcgtccagcaccagcatcttcacgttagaaagatcaaacccgctagtttggtccatgtgttgtaacagtcgtccgggtgtacaaatgagaatgttcagcttggccagtcggtcagcctccatggcaacgtcctttcctccaataaccaaaccagcagagaagctgtgacaacggccgatttttcgcagaacctggaaaatctggaccgccagttctcgagtcggactaataaccagggctcctaaaccatccacatcactccacttgtttcgaaacaggcactccaacacaggcaccagaaacgccagagtcttaccacttccggtacgcgctgctccaagcagatcgtggccttgcagagcgggagggatggcccgcttctgaacatcggtacaggtgacataatgtgaattttttagaccctcaatagtagcctcagacaagggcagctcctcaaacttggacacctccttgtcggcctcgtcctctccaaagttgtcgacgcgctcctgcagcttggagagcttctgtttgtgttcctctcgtttgattttacgaggatcggctcgtttcttcattttcgccatatctcaagctgtcggataaatttcttggacaaaaaaatctaacttttcgtgcgccttcacttttatcagtctgaaaattacacatgcatgcagcttggagtatggaggcgacagaggtgcatgccagagtgcatgaattagggcaacgggggtgtgaagaagggcgcaaaagatgtgacgacggtgcaagacgacggtatactgcagacaaggtctttcactgcaaaactcctggttaaatcgtgggtcccgcgtctccgtatcatatgactttgggtcacgtgactgcaagatttttaaggtttcgaactcccaaattgagtcacgtgtcgtctctctgcaacatgaggtatcgtaaattaggaatgactcgacctgacaggccatcaaggaccctgatgcaactctgaaattagagggaggaggtaatgagaaacagtgctggattgtggtgagacattgaagcgggattggttaacctgtttcttttttgtcgtttgctcttcattattgcgatttttgtagtcatttgattagatcagatcagcagtcccctcatgctgtcgttgatgggcgcgtaatcagtgtaacgctttgaatgaggatggtgtgagtaatactggtttcattgggggggggggggggggtactgttactcgaaaaacaaatcatatgcatctctgaacgtgccggggtgtggcatgtttctcgcttcgaaaaataaatgttggctgttccaggcttgtctcagacctgcaagaatcatactggcgtaatctccgccaggtctggtcaggaacaagagagtaaaagaaatgtttgagtctcggctttcacatcctcggcactagataagcagcaatatcaatgtcacattgcttgcttgtgcaggtcagggggagggggatgtatatgatacaagcaggttcgcatctacagaatctacagtatgtatctgatgatagccttacacagcgcacgcagatgtagtttttgggttgaacagtgtcagcggaagcggcgtagtggggtactgtagtacagaatcaacggaatgaagtttacaactgcttctgttactgtagcctttcactgttcaaatgataacgttggagaagagtgcaccctctgttagataggattacagtccagacacacattggcaccgaagtctgtagtcaaacattggtctcagttggtgtaatgacattcaatagactgattctgcaactcctacaccttgcattgtacacccgagaccccttgtacggcccgcatttctccttcacatgtcggcatgtgtcttgtctgtagccacttcaatgggatgcagtattagcactgtcggacacacctcagtcaatgggaatggaatgccatgctcctagcggctcattgtttgctaggaaatacagttaatagcacagatcatagagtctaggctctatacgtcttagaacaaccattatttgtttaaacgacaacttggtaagcgaattacagtaagtagctattgtttctatctctgtcagtgttcggataagtccttagatcaccatactcaaagtggtacgtttcgtcgcatcggacgagaagtgtgtctatcaccgtttctttttgccgctctcatttttgcggtcggaataattactgtggaccctcggcgccgaccgttttgcagggctcatcaacctaaaacttctccgagtctgtgccttcaggtgggcatagttgatgggtgttttgaagttaatagtggggaagaactatggcaaacaagcagatgcaggcaccttgtaactgcagaccggttcttgtctaccgactccgctgcacctgtgccgcggtacatgtcgtcacaggctgcggggttcggaggcccccttgcaacctcctttgatagttgctatggccccaaagagttatacgagatagacccacagatctacttgactgttgtcacagaacctgctaggtttgcttattgtacccgctttgtagctactgtacaacgacaacgtctaaaattgagacgcgaacaaactccagatgcagaacccaaacctctctctcagagtttcgagtgcttctacctcacagtaaagtggaggtggacctgcaagggaattcagtcacaaggccccgaatgtctccgaaactccaatcggaccgtttaaacagactaatatcacgtcattgattgatattagcatccggcaagagccgcaaggttatctcctcaccaatgagcctgttgtacggctcattccgcatctgcggctgattcagtttcgagtggggatggtagacttcattgcagcattcctaaccttctacttggtccgtggagatgtcatggacatcgattttgggctgagaagccttttgacgatgtcgatatcactgaccgctaatttactctggcagtttctccggctctcgaggcatcgtcgatcaccaaacactatctgctagtctaaatgtccgacacgacagcttttgatcgccgtgaacggcgcagacctcatgcaccatgcaccagggccaaatcaattacgggtcgcttagcgttgcagtcggggcattatggtggaagttccgatacggcacagacacattccatagtggggggattggattataaaagggccatagaaagccctcaattgatacccaagtaccagctcccctcactatgaagctttccaccatccttttcacagcctgcgctaccctggctgccgccctcccttcccccatcactccttctgaggccgcagttctccagaagcgagtgtacacctctaccgagacctctcacattgaccaggagtcctacaacttctttgagaagtacgcccgactcgcaaacattggatattgtgttggtcccggcactaagatcttcaagcccttcaactgtggcctgcaatgtgcccacttccccaacgttgagctcatcgaggagttccacgacccccgtctcatctttgatgtttctggttacctcgctgttgatcatgcctccaagcagatctaccttgttattcgaggaacccactctctggaggacgtcataaccgacatccgaatcatgcaggctcctctgacgaactttgatcttgctgctaacatctcttctactgctacttgtgatgactgtcttgtccacaatggcttcatccagtcctacaacaacacctacaatcagatcggccccaagctcgactctgtgattgagcagtatcccgactaccagattgctgtcaccggtcactctctcggaggagctgcagcccttctgttcggaatcaacctcaaggttaacggccacgatcccctcgttgttactcttggtcagcccattgtcggtaacgctggctttgctaactgggtcgataaactcttctttggccaggagaaccccgatgtctccaaggtgtccaaagaccgaaagctctaccgaatcacccaccgaggagatatcgtccctcaagtgcccttctgggacggttaccagcactgctctggtgaggtctttattgactggcccctgatccaccctcctctctccaacgttgtcatgtgccagggccagagcaataaacagtgctctgccggtaacactctgctccagcaggtcaatgtgattggaaaccatctgcagtacttcgtcaccgagggtgtctgtggtatctaagctatttatcactctttacaacttctacctcaactatctactttaataaatgaatatcgtttattctctatgattactgtatatgcgttcctctaagacaaatcgaaaccagcatgcgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgaaactctcaaacacagtccagaggtcctttatagcttgatctgtatccagatagcctccgtaattggtgtgtgtcttcaaatcccagacgtccacattggcatgtcctccactgataagcatttgaagttcatctgcgttgaacattgagacccacgaagggtcaatgagctggtatagaccgcccaagaatgcatctgtctgtgttctgatactggtgttaagctt

SEQ ID NO: 83 - protein, 334 aa, Yarrowia lipolytica (GenBank Accession No. AJ012632)
MKLSTILFTACATLAAALPSPITPSEAAVLQKRVYTSTETSHIDQESYNFFEKYARLANIGYCVGPGTKIFKPFNCGLQCAHFPNVELIEEFHDPRLIFDVSGYLAVDHASKQIYLVIRGTHSLEDVITDIRIMQAPLTNFDLAANISSTATCDDCLVHNGFIQSYNNTYNQIGPKLDSVIEQYPDYQIAVTGHSLGGAAALLFGINLKVNGHDPLVVTLGQPIVGNAGFANWVDKLFFGQENPDVSKVSKDRKLYRITHRGDIVPQVPFWDGYQHCSGEVFIDWPLIHPPLSNVVMCQGQSNKQCSAGNTLLQQVNVIGNHLQYFVTEGVCGI

SEQ ID NO: 84 - DNA, 3630 bp, Yarrowia lipolytica (GenBank Accession No. AJ249751)
  CDS (1810)..(3306): Lip3
cgacactgaaacagactcccgtcttcgtctgcgatacatggcttcgagagtcgcatttccacactcagcggtagatgcacctgcgacggcaaggcttcagtccgactcacattcccgcgtctgatctcccagagaactccggagtggtctacacaatgttatcgatacccccggcaaatgactccattctgcccacaaaactttgacaaattccacccccagtccccgaataagatatcacgggactcaagcaatcgctctctagcatgtttcagttctttgaattcatattctgactatcgcccaaaaagtcacgttacggaccaaacgaaatcacatgacccatgaaacgaaatcacatgaccagcagccatttagatcgtcgttttggtcacatgacatatcgctttcacccctccgaaatgtctccggaacctgcctctagtaccctaaccctgttcagatgcatcggttttaacggtttttcggccgactttatttgtgtggggtaaggatgagccgaggttgtgaattgcggtttaggatcaagtatttcagggttaggcaagtaaatggagtgggcaaaggggttggggttgatatgaggaaaaaaattggtctccacaagtctccgttgttccagcagagatcgagtctgtatttttcacatttgtttctaattttgattactaacaaacattaaatatatcggttatagaaatatacataaatggcgtcattatgagtgagttgtagttgatatatacaagaaaatcggcgaaaaaagtcaatatgaaaacgagcaagaactccccgacgtaatctgatcattattggacgagttacagggagtaggatgtggttgaggtctatggttggagtaattgtagtatggaagaagttacagaggttgaagagcctccgctggaacttggaatgtgttaattggggtggtatatttctactgaagtaaattcatcaaaatccgatgggaattggggtgattgccgatatgcgattttcgacgcatgtcttgtggtctttgctatcgcttgataggaagacgataaagactggaaataggtccaatgacacattatactacgagaaaattggattgagaccaataacgggcacttttgagtattctttattccatgagaggagatttacatgttggaaacagaacaggggttttaagagtctaagtacttcagaatcgtcatttttgacgctgaaaactgtgaaaaaaacgttagctataattgctgccgttgtggagacatatctgatcaacttcaaaccccagaatgtctctcatttacgtcatctgaatcggatctcatttttctccatgaaatctccaactttaatgattagccgagagattgcggtcagacggacgcaagttgccgaaaaacggtcctatagcggatattaaagtgggattcaattctcctagttccaaggagtccactgaacctctctcatctcctacattttcccccaaaacccttcaaaatggagcatctatttcacccccgattccacatgcaccccacacgcatgcatgcatgcagctgcataaaccgaaaaacgcaccgaaataaaagatagagaaagaagttgacttcctctccattttttgtgacgagttaaacaaataccacgcgcgcgaaaacggcccagaaacaactcgaatcgacttgcaatccgcccagcgagtctcacagacgcaaaccaatagacacaccaatcgacaccacaccaaacgacactaccccaatagacggtctttccccagtcgccatgcctctcgaactcccctcgctcaacgcctcgattgtcggcaacaccgttcagaacggcgctgttgagcagtttctcaacatccgatacgccgacattcctggcaagtttgagaagcccgtgctcaagaacgattggaacggcgcggagatcgacgccaccaaggtcggtcccgtgtgcccccaaccccgcaccccattcaacttcttctccgtgccagacgacctctgggagaaagtcaatgtggacacgtaccaggacggtctgctgtgcgacaacctgattgtgacgcgaccgaagggcgtgtctgccaacgcccggctgcccactgttgtgtggatccacggcggctccaatattgagggcagtatctacaacctcatctatgagccccagttcctggtggcagagtcggtgcgagtaggcaagccgattgtgcacgtgtgtatcgagtaccgactgggtctcgcgggcttcctcaccaagaacggcaagggcaactggggcacgtgggatcagtacacgggctgccagtgggtcaaccgccacattcaggactttggaggcgatcctttgaacgtgacattgaccggtgagtctgccggctctgtagcagtccataacatgctcatcaaggactccatgaacggccgaaagttgttccgaaatgccgtcatgatgagtggcactctcgagaccatcactcctcagcctcccaagtggcatgctcgtttggaggagaaggtggccaaggtcactggcaaggaagtggccgaccttgcttctctgtccgataaggagctgctcgacgcccagatcaagctcaatgtggctgtgtgcatgacttgcgacgacggcgactttttcgagcccggatggaagcagcatctgactcctgactggctcgacaagctcatcatctccgattgcaaggacgagggcatgctgtatttcctgccagtcaacgcgcaggacgacgaggagctgttggcaaaggtggccaagtcgcccgtgggtaaggagatttccgagctttacggcatcaaggagggtggcgatatcaagtctgcgtgtctcgatctcaagactgacgccaccttcaattactttaaccatctgctgttcaagaagatggaggaggcccgaaacaacggctccacttctcgagtttaccgtctggccgtcgatgagcccaacccccacaaccccgaccagcgggcccaccacgccgtcgacgtgctgtacatgttcaactcgaccaagttcaacgagcacggcgacaagctgtctcggctgttccagagccactttttgcggctggcgtatggcctggagccctgggaccatcgaaactttggagtgtacagaaacggcggctaccagcagctgccgctgagtgagttgaacaaggtccgacccgtcgagcggtacgaggcgctgtccaagatggactttggccaggttgggcgtttgtccaatgcgctttcgcgcctatgaatcgcggatgaatatctggacacgtatcactatgaaattgccattgatgaaatcgggcttagtgaatgtgagccaggggatgagatggtagatgttgatgtgcgttcaagtgattcggttgatgttggaggacaggccgagccgcgaagatagatagatttgtaaatgagtgttttgttgatcttatcgaatatctcccattctctactgtacgtactgcagcgcaatgtagttgctggaggtggttgggcgacttgttgagcatcaggaccagctgatcgggatatacaatacatggttgtggtcggcttgacggcagttttc

SEQ ID NO: 85 - protein, 498 aa, Yarrowia lipolytica (GenBank Accession No. AJ249751)
MPLELPSLNASIVGNTVQNGAVEQFLNIRYADIPGKFEKPVLKNDWNGAEIDATKVGPVCPQPRTPFNFFSVPDDLWEKVNVDTYQDGLLCDNLIVTRPKGVSANARLPTVVWIHGGSNIEGSIYNLIYEPQFLVAESVRVGKPIVHVCIEYRLGLAGFLTKNGKGNWGTWDQYTGCQWVNRHIQDFGGDPLNVTLTGESAGSVAVHNMLIKDSMNGRKLFRNAVMMSGTLETITPQPPKWHARLEEKVAKVTGKEVADLASLSDKELLDAQIKLNVAVCMTCDDGDFFEPGWKQHLTPDWLDKLIISDCKDEGMLYFLPVNAQDDEELLAKVAKSPVGKEISELYGIKEGGDIKSACLDLKTDATFNYFNHLLFKKMEEARNNGSTSRVYRLAVDEPNPHNPDQRAHHAVDVLYMFNSTKFNEHGDKLSRLFQSHFLRLAYGLEPWDHRNFGVYRNGGYQQLPLSELNKVRPVERYEALSKMDFGQVGRLSNALSRL

SEQ ID NO: 86 - protein, 406 aa, Yarrowia lipolytica (GenBank Accession No. XP_503825)
  MISC_FEATURE (1)..(406): Lip4a
MTFTIGIMNLTLGQVVAYLYASLFGEPPATLSKTRVQASQELYNFTAKFSRIANIAYCVNAPVTPLRTDFTCGESCRYFPNMTLDSVFGGDFYSTSITGYIAYDHLNKEKYVVIRGTFSIPDAVTDIQFQQSPWLVELPKHLIPTQDDMKQRWAVRPDLEVENKGLDNLKERALVVEDPRLIPIKTSECKGCMIHDGFAKAFNETMVNAAPQFEKFLTNHTDYKMYVTGHSLGAAQALLFATHFKLLGHDPTMINFGQPRVGNSEFANYINQLWFNDTGLEVNDKRRNYRLTHWNDIFVGLPDWSNYTHAIGEVYIDQESVYPALDKVSVCEGGENEACHRGTFNLWSRIDLLQNHLAYIYYIGYCALNIGRRNVLAMPKYHGNNSYKYATEPGYTGPGRTLVPTN

SEQ ID NO: 87 - DNA, 390 bp, Yarrowia lipolytica (GenBank Accession No. XM_503410)
  CDS (1)..(390): SCP2 (YALI0E01298g)
atgtctctcaaggtcgacggcttcacttcttctatcatcttcgacgtcatccgtgacggtcttaacgacccctctcaggccaagcagaaggctgagtccatcaagaaggccaacgccatcattgtcttcaacctcaagaacaaggctggcaagaccgagtcttggtaccttgacctcaagaacgacggtgacgtcggcaagggcaacaagtcccccaagggtgatgctgacatccagctcactctctctgacgaccacttccagcagctcgttgagggtaaggctaacgcccagcgactcttcatgaccggcaagctcaaggttaagggcaacgtcatgaaggctgccgccattgagggtatcctcaagaacgctcagaacaacctctaa

SEQ ID NO: 88 - protein, 129 aa, Yarrowia lipolytica (GenBank Accession No. XM_503410)
MSLKVDGFTSSIIFDVIRDGLNDPSQAKQKAESIKKANAIIVFNLKNKAGKTESWYLDLKNDGDVGKGNKSPKGDADIQLTLSDDHFQQLVEGKANAQRLFMTGKLKVKGNVMKAAAIEGILKNAQNNL

SEQ ID NO: 89 - DNA, 546 bp, Yarrowia lipolytica (GenBank Accession No. XM_501987)
  CDS (1)..(546): YALI0C18711g
atgcatctactacaactaagttgttcatcatcaactttcatctttcaacacgatacaccacataacatgtccacgcgagacaccttttacgggtggtattttgccatccactttgtcatcaccctgatggtcgatggaggctttgccattcctgcggcgtacaaactacccgggcaacagttcatggaagacttccacgtggcatccaacaaggatttcattgtgctcgaaaaaccagcgtggttcatgtccttcatctggatcgagatcctcttccagctgcccttctttgtttatggagcctacaagctgctaaccaagaccgccactcccacgacatacctgtggatgctggtgtacggtgtcaatgccagcctaacgactctggcatgtctcgcggaggtgtgggctcgagccggtcttaccgatgcccttcgatacaacctgctcgctgtctacgccccctttttcttcatttctggctacattgtcattgacgtattccagcggttgcagggagagctgagaaaggtcaagactgattaa

SEQ ID NO: 90 - protein, 181 aa, Yarrowia lipolytica (GenBank Accession No. XM_501987)
MHLLQLSCSSSTFIFQHDTPHNMSTRDTFYGWYFAIHFVITLMVDGGFAIPAAYKLPGQQFMEDFHVASNKDFIVLEKPAWFMSFIWIEILFQLPFFVYGAYKLLTKTATPTTYLWMLVYGVNASLTTLACLAEVWARAGLTDALRYNLLAVYAPFFFISGYIVIDVFQRLQGELRKVKTD

SEQ ID NO: 91 - DNA, 1556 bp, Yarrowia lipolytica (GenBank Accession No. XM_505819)
  CDS (501)..(1556): YALI0F24167g
gctccaactttcacgtggcgtcacacacacaggttcatgcacatcccgttttcaaagttgcattgcatgcatttcgttcccttagattgaccggaacaattatcttggcgcactgagaatgacctcacctcattatcggtgcagatcccgagagccgagggtcggaggtctctggtgagctcgagatgcgttgcaatgacagctgggacgggtccgcgacacacagggggatatcctgctgttctcgatggctatctgtgctgcccactagtgcgccatttctttccacaccacacactgagcctaggtttttcgtttttctgcttttgggtggctccagccggaccttcccgctacaggagccgaaaaaccactgttttggattgagtttcaagctcgaactctacacctggaaactttgctttgacagcaaaatggataagcgcaggtaatgaaacccaatgcgggagtgagacaagcacggataaatttgggcgctgatgcctataaaagacttcactaacccagctttttcgaacccacaagagacatcctcacagcatacacacacaaaaatgccttctgtcgccgacaacacttccaacggtcccattgagggcaacgttctgccccagtccaagttcatccagcacctgagcgagtatccagctgttgctgccgtgactggcttcgctgcctctttccccgttgtcaagatttttgcatccaacgccgttcctctcatccaggccatccagaaccgaggtgcccccgtcgccgagcccgtcgtcaagcgagccgccccctacatctctcagattgacaacgctgccgacgaggccctcaaccgactcgacaaggccgtgccctctctcaagaacaccaagcccgacgaggtctacagccgaatcgtgacccagcccttggagaacgtgcgaggtactgtcgacaagtacgccgacgagaccaagaacactgtctcccgagtggttgtgcagcccatccgagacgttgcctccagagtccagtcccaggttgtcacctactacgatgcccatggaaagcccattgtccacgcccgactcgaccccatcttccaccctctcaacgaccgtctcgaagccctgatcaacgcctacctgcccaagggccaggagattgtgactgatgccgagaacgagctggcccgagcatggcgcctcaccgtggttgcttttgaccgagcccgacctctgattgagcagcagacttcccagattcaggaaatcaaccagcacacccgagaacacatccagaaggtttacgacggcaagcgatcggaaatcgacgataagaagactgtctctggtccagtatacgccaccgtcgccactgtccgagatctttcacaggagggcctccagtacgcccagtccattctgaatgccaagaagcccgaggagaaggccgactctaactctggtgttgctcccgtgagccagcctcacaccacctccgctgttgacaactccctcgctgctcccaccgccgttcacgaggttactgcttctgcttaa

SEQ ID NO: 92 - protein, 351 aa, Yarrowia lipolytica (GenBank Accession No. XM_505819)
MPIKDFTNPAFSNPQETSSQHTHTKMPSVADNTSNGPIEGNVLPQSKFIQHLSEYPAVAAVTGFAASFPVVKIFASNAVPLIQAIQNRGAPVAEPVVKRAAPYISQIDNAADEALNRLDKAVPSLKNTKPDEVYSRIVTQPLENVRGTVDKYADETKNTVSRVVVQPIRDVASRVQSQVVTYYDAHGKPIVHARLDPIFHPLNDRLEALINAYLPKGQEIVTDAENELARAWRLTVVAFDRARPLIEQQTSQIQEINQHTREHIQKVYDGKRSEIDDKKTVSGPVYATVATVRDLSQEGLQYAQSILNAKKPEEKADSNSGVAPVSQPHTTSAVDNSLAAPTAVHEVTASA

SEQ ID NO: 93 - DNA, 2119 bp, Yarrowia lipolytica
  CDS (291)..(1835): DGAT2 opening reading frame, comprising 2 smaller internal opening reading frames
  misc_feature (291)..(293): initiation codon ('ATG')
  misc_feature (456)..(458): initiation codon ('ATG')
  misc_feature (768)..(770): initiation codon ('ATG')
aaacgcacccactgctcgtcctccttgctcctcgaaaccgactcctctacacacgtcaaatccgaggttgaaatcttccccacatttggcagccaaaccagcacatcccagcaacctcgcacagcgccgaaatcgacctgtcgacttggccacaaaaaaaagcaccggctctgcaacagttctcacgaccaattacgtacaagtacgaaatcgttcgtggaccgtgactgataagctcccactttttcttctaacaacaggcaacagacaagtcacacaaaacaaaagctatgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatctccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaaggaaaactgcctgggttaggcaaatagctaatgagtatttttttgatggcaaccaaatgtagaaagaaaaaaaaaaaaaaagaaaaaaaaaagagaatattatatctatgtaattctattaaaagctctgttgagtgagcggaataaatactgttgaagaggggattgtgtagagatctgtttactcaatggcaaactcatctgggggagatccttccactgtgggaagctcctggatagcctttgcatcggggttcaagaagaccattgtgaacagcccttga

SEQ ID NO: 94 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIISTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 95 - protein, 1024 aa, Yarrowia lipolytica CLIB122 (GenBank Accession No. CAG82178)
  MISC_FEATURE (1)..(1024): YlPex1p
MTSKSDYSGKDKIELDPVFAKSIDLLPNTQVVIDIQLNPKIAHTIHLEPVTVADWEIVELHAAYLESRMINQVRAVSPNQPVTVYPSSTTSATLKVIRIEPDLGAAGFAKLSPDSEVVVAPKQRKKEEKQVKKRSGSARSTGSQKRKGGRGPHALRRAISEDFDGHLRLEVSLDVSQLPPEFHQLKNVSIKVITPPNLASPQQAASIAVEEKSEESLSQNKPPSSEPKVEVPPDIINPASEIVATLVNDTTSPTGHAKLSYALADALGIPSSVGHVIRFESASKPLSQKPGALVIHRFITKTVGAAEQKSLRLKGEKNADDGVSADDQFSLLEELKKLQMLEGPITNFQRLPPIPELLPLGGVIGLQNSEGWIQGGYLGEEPIPFVSGSEILRSESSLSPSNIESEDKRVVGLDNMLNKINEVLSRDSIGCLVYGSRGSGKSAVLNHIKKECKVSHTHTVSIACGLIAQDRVQAVREILTKAFLEASWFSPSVLFLDDIDALMPAEVEHADSSRTRQLTQLFLELALPIMKSRHVSVVASAQAKESLHMNLVTGHVFEELFHLKSPDKEARLAILSEAVKLMDQNVSFSQNDVLEIASQVDGYLPGDLWTLSERAQHEMALRQIEIGLENPSIQLADFMKALEDFVPSSLRGVKLQKSNVKWNDIGGLKETKAVLLETLEWPTKYAPIFASCPLRLRSGLLLYGYPGCGKTYLASAVAAQCGLNFISIKGPEILNKYIGASEQSVRELFERAQAAKPCILFFDEFDSIAPKRGHDSTGVTDRVVNQMLTQMDGAEGLDGVYVLAATSRPDLIDPALLRPGRLDKMLICDLPSYEDRLDILRAIVDGKMHLDGEVELEYVASRTDGFSGADLQAVMFNAYLEAIHEVVDVADDTAADTPALEDKRLEFFQTTLGDAKKDPAAVQNEVMNARAAVAEKARVTAKLEALFKGMSVGVDNDDDKPRKKAVVVIKPQHMNKSLDETSPSISKKELLKLKGIYSQFVSGRSGDMPPGTASTDVGGRATLA

SEQ ID NO: 96 - protein, 381 aa, Yarrowia lipolytica CLIB122 (GenBank Accession No. CAG77647)
  MISC_FEATURE (1)..(381): YlPex2p
MSSVLRLFKIGAPVPNVRVHQLDASLLDAELVDLLKNQLFKGFTNFHPEFRDKYESELVLALKLILFKLTVWDHAITYGGKLQNLKFIDSRHSSKLQIQPSVIQKLGYGILVVGGGYLWSKIEGYLLARSEDDVATDGTSVRGASAARGALKVANFASLLYSAATLGNFVAFLYTGRYATVIMRLLRIRLVPSQRTSSRQVSYEFQNRQLVWNAFTEFLIFILPLLQLPKLKRRIERKLQSLNVTRVGNVEEASEGELAHLPQKTCAICFRDEEEQEGGGGASHYSTDVTNPYQADCGHVYCYVCLVTKLAQGDGDGWNCYRCAKQVQKMKPWVDVDEAAVVGAAEMHEKVDVIEHAEDNEQEEEEFDDDDEDSNFQLMKD

SEQ ID NO: 97 - protein, 431 aa, Yarrowia lipolytica CLIB122 (GenBank Accession No. CAG78565)
  MISC_FEATURE (1)..(431): YlPex3p
MDFFRRHQKKVLALVGVALSSYLFIDYVKKKFFEIQGRLSSERTAKQNLRRRFEQNQQDADFTIMALLSSLTTPVMERYPVDQIKAELQSKRRPTDRVLALESSTSSSATAQTVPTMTSGATEEGEKSKTQLWQDLKRTTISRAFSLVYADALLIFFTRLQLNILGRRNYVNSVVALAQQGREGNAEGRVAPSFGDLADMGYFGDLSGSSSFGETIVDPDLDEQYLTFSWWLLNEGWVSLSERVEEAVRRVWDPVSPKAELGFDELSELIGRTQMLIDRPLNPSSPLNFLSQLLPPREQEEYVLAQNPSDTAAPIVGPTLRRLLDETADFIESPNAAEVIERLVHSGLSVFMDKLAVTFGATPADSGSPYPVVLPTAKVKLPSILANMARQAGGMAQGSPGVENEYIDVMNQVQELTSFSAVVYSSFDWAL

SEQ ID NO: 98 - protein, 395 aa, Yarrowia lipolytica CLIB122 (GenBank Accession No. CAG83356)
  MISC_FEATURE (1)..(395): YlPex3Bp
MLQSLNRNKKRLAVSTGLIAVAYVVISYTTKRLIEKQEQKLEEERAKERLKQLFAQTQNEAAFHTASVLPQLCEQIMEFVAVEKIAEQLQNMRAEKRKKQNMDDDKHSVLSLGTETTASMADGQKMSKIQLWDELKIESLTRIVTLIYCVSLLNYLIRLQTNIVGRKRYQNEAGPAGATYDMSLEQCYTWLLTRGWKSVVDNVRRSVQQVFTGVNPRQNLSLDEFATLLKRVQTLVNSPPYSTTPNTFLTSLLPPRELEQLRLEKEKQSLSPNYTYGSPLKDLVFESAQHIQSPQGMSSFRAIIDQSFKVFLEKVNESQYVNPPSTGGKRIAVGALQPPIISGGPKKVKLASLLSVATRQSSVISHAQPNPYVDAINSVAEYNGLCAVIYSSFEQ

SEQ ID NO: 99 - protein, 153 aa, Yarrowia lipolytica CLIB122 (GenBank Accession No. CAG79130)
  MISC_FEATURE (1)..(153): YlPex4p
MASQKRLIKELAAYKKDPNPCLASLTADGDSLYKWTAVMRGTEGTAYENGLWQVEINIPENYPLQPPTMFFRTKICHPNIHFETGEVCIDVLKTQWSPAWTISSACTAVSAMLSLPEPDSPLNIDAANLVRCGDESAMEGLVRYYVNKYASGN

SEQ ID NO: 100 - protein, 598 aa, Yarrowia lipolytica CLIB122 (GenBank Accession No. CAG78803)
  MISC_FEATURE (1)..(598): YlPex5p
MSFMRGGSECSTGRNPLSQFTKHTAEDRSLQHDRVAGPSGGRVGGMRSNTGEMSQQDREMMARFGAAGPEQSSFNYEQMRHELHNMGAQGGQIPQVPSQQGAANGGQWARDFGGQQTAPGAAPQDAKNWNAEFQRGGSPAEAMQQQGPGPMQGGMGMGGMPMYGMARPMYSGMSANMAPQFQPQQANARVVELDEQNWEEQFKQMDSAVGKGKEVEEQTAETATATETVTETETTTEDKPMDIKNMDFENIWKNLQVNVLDNMDEWLEETNSPAWERDFHEYTHNRPEFADYQFEENNQFMEHPDPFKIGVELMETGGRLSEAALAFEAAVQKNTEHAEAWGRLGACQAQNEKEDPAIRALERCIKLEPGNLSALMNLSVSYTNEGYENAAYATLERWLATKYPEVVDQARNQEPRLGNEDKFQLHSRVTELFIRAAQLSPDGANIDADVQVGLGVLFYGNEEYDKAIDCFNAAIAVRPDDALLWNRLGATLANSHRSEEAIDAYYKALELRPSFVRARYNLGVSCINIGCYKEAAQYLLGALSMHKVEGVQDDVLANQSTNLYDTLKRVFLGMDRRDLVAKVGNGMDVNQFRNEFEF

SEQ ID NO: 101 - protein, 1024 aa, Yarrowia lipolytica CLIB122 (GenBank Accession No. CAG82306)
  MISC_FEATURE (1)..(1024): YlPex6p
MPSISHKPITAKLVAAPDATKLELSSYLYQQLFSDKPAEPYVAFEAPGIKWALYPASEDRSLPQYTCKADIRHVAGSLKKFMPVVLKRVNPVTIEHAIVTVPASQYETLNTPEQVLKALEPQLDKDRPVIRQGDVLLNGCRVRLCEPVNQGKVVKGTTKLTVAKEQETIQPADEAADVAFDIAEFLDFDTSVAKTRESTNLQVAPLEGAIPTPLSDRFDDCESRGFVKSETMSKLGVFSGDIVSIKTKNGAERVLRLFAYPEPNTVKYDVVYVSPILYHNIGDKEIEVTPNGETHKSVGEALDSVLEAAEEVKLARVLGPTTTDRTFQTAYHAGLQAYFKPVKRAVRVGDLIPIPFDSILARTIGEDPEMSHIPLEALAVKPDSVAWFQVTSLNGSEDPASKQYLVDSSQTKLIEGGTTSSAVIPTSVPWREYLGLDTLPKFGSEFAYADKIRNLVQISTSALSHAKLNTSVLLHSAKRGVGKSTVLRSVAAQCGISVFEISCFGLIGDNEAQTLGTLRAKLDRAYGCSPCVVVLQHLESIAKKSDQDGKDEGIVSKLVDVLADYSGHGVLLAATSNDPDKISEAIRSRFQFEIEIGVPSEPQRRQIFSHLTKSGPGGDSIRNAPISLRSDVSVENLALQSAGLTPPDLTAIVQTTRLRAIDRLNKLTKDSDTTLDDLLTLSHGTLQLTPSDFDDAIADARQKYSDSIGAPRIPNVGWDDVGGMEGVKKDILDTIETPLKYPHWFSDGVKKRSGILFYGPPGTGKTLLAKAIATTFSLNFFSVKGPELLNMYIGESEANVRRVFQKARDAKPCVVFFDELDSVAPQRGNQGDSGGVMDRIVSQLLAELDGMSTAGGEGVFVVGATNRPDLLDEALLRPGRFDKMLYLGISDTHEKQQTIMEALTRKFRLAADVSLEAISKRCPFTFTGADFYALCSDAMLNAMTRTANEVDAKIKLLNKNREEAGEEPVSIRWWFDHEATKSDIEVEVAQQDFEKAKDELSPSVSAEELQHYLKLRQQFEGGKK

SEQ ID NO: 102 - protein, 356 aa, Yarrowia lipolytica CLIB122 (GenBank Accession No. CAG78389)
  MISC_FEATURE (1)..(356): YlPex7p
MLGFKTQGFNGYAANYSPFFNDKIAVGTAANYGLVGNGKLFILGISPEGRMVCEGQFDTQDGIFDVAWSEQHENHVATACGDGSVKLFDIKAGAFPLVSFKEHTREVFSVNWNMANKALFCTSSWDSTIKIWTPERTNSIMTLGQPAPAQGTNASAHIGRQTAPNQAAAQECIYSAKFSPHTDSIIASAHSTGMVKVWDTRAPQPLQQQFSTQQTESGGPPEVLSLDWNKYRPTVIATGGVDRSVQVYDIRMTQPAANQPVQPLSLILGHRLPVRGVSWSPHHADLLLSCSYDMTARVWRDASTGGNYLARQRGGTEVKCMDRHTEFVIGGDWSLWGDPGWITTVGWDQMVYVWHA

SEQ ID NO: 103 - protein, 671 aa, Yarrowia lipolytica CLIB122 (GenBank Accession No. CAG80447)
  MISC_FEATURE (1)..(671): YlPex8p
MNKYLVPPPQANRTVTNLDLLINNLRGSSTPGAAEVDTRDILQRIVFILPTIKNPLNLDLVIKEIINSPRLLPPLIDLHDYQQLTDAFRATIKRKALVTDPTISFEAWLETCFQVITRFAGPGWKKLPLLAGLILADYDISADGPTLERKPGFPSKLKHLLKREFVTTFDQCLSIDTRNRSDATKWVPVLACISIAQVYSLLGDVAINYRRFLQVGLDLIFSNYGLEMGTALARLHAESGGDATTAGGLIGKKLKEPVVALLNTFAHIASSCIVHVDIDYIDRIQNKIILVCENQAETWRILTIESPTVMHHQESVQYLKWELFTLCIIMQGIANMLLTQKMNQFMYLQLAYKQLQALHSIYFIVDQMGSQFAAYDYVFFSAIDVLLSEYAPYIKNRGTIPPNKEFVAERLAANLAGTSNVGSHLPIDRSRVLFALNYYEQLVTVCHDSCVETIIYPMARSFLYPTSDIQQLKPLVEAAHSVILAGLAVPTNAVVNAKLIPEYMGGVLPLFPGVFSWNQFVLAIQSIVNTVSPPSEVFKTNQKLFRLVLDSLMKKCRDTPVGIPVPHSVTVSQEQEDIPPTQRAVVMLALINSLPYVDIRSFELWLQETWNMIEATPMLAENAPNKELAHAEHEFLVLEMWKMISGNIDQRLNDVAIRWWYKKNARVHGTL

SEQ ID NO: 104 - protein, 377 aa, Yarrowia lipolytica CLIB122 (GenBank Accession No. CAG81606)
  MISC_FEATURE (1)..(377): YlPex10p
MWGSSHAFAGESDLTLQLHTRSNMSDNTTIKKPIRPKPIRTERLPYAGAAEIIRANQKDHYFESVLEQHLVTFLQKWKGVRFIHQYKEELETASKFAYLGLCTLVGSKTLGEEYTNLMYTIRDRTALPGVVRRFGYVLSNTLFPYLFVRYMGKLRAKLMREYPHLVEYDEDEPVPSPETWKERVIKTFVNKFDKFTALEGFTAIHLAIFYVYGSYYQLSKRIWGMRYVFGHRLDKNEPRIGYEMLGLLIFARFATSFVQTGREYLGALLEKSVEKEAGEKEDEKEAVVPKKKSSIPFIEDTEGETEDKIDLEDPRQLKFIPEASRACTLCLSYISAPACTPCGHFFCWDCISEWVREKPECPLCRQGVREQNLLPIR

SEQ ID NO: 105 - protein, 408 aa, Yarrowia lipolytica CLIB122 (GenBank Accession No. CAG81532)
  MISC_FEATURE (1)..(408): YlPex12p
MDYFSSLNASQLDPDVPTLFELLSAKQLEGLIAPSVRYILAFYAQRHPRYLLRIVNRYDELYALFMGLVEYYNLKTWNASFTEKFYGLKRTQILTNPALRTRQAVPDLVEAEKRLSKKKIWGSLFFLIVVPYVKEKLDARYERLKGRYLARDINEERIEIKRTGTAQQIAVFEFDYWLLKLYPIVTMGCTTATLAFHMLFLFSVTRAYSIDDFLLNIQFSRMTRYDYQMETQRDSRNAANVAHTMKSISEYPVAERVMLLLTTKAGANAMRSAALSGLSYVLPTSIFALKFLEWWYASDFARQLNQKRRGDLEDNLPVPDKVKGADKLAESVAKWKEDTSKCPLCSKELVNPTVIESGYVFCYTCIYRHLEDGDEETGGRCPVTGQKLLGCRWQDDVWQVTGLRRLMV

SEQ ID NO: 106 - protein, 412 aa, Yarrowia lipolytica CLIB122 (GenBank Accession No. CAG81789)
  MISC_FEATURE (1)..(412): YlPex13p
MSVPRPKPWEGASGSSAATATPAATATPASTDAVSSSAGSATGAPELPSRPSAMGSTSNALSSPMGSSMNSGYGGMNSGYGGMGSSYGSGYGSSYGMGSSYGSGYGSGLGGYGSYGGMGGMGGMYGSRYGGYGSYGGMGGYGGYGGMGGGPMGQNGLAGGTQATFQLIESIVGAVGGFAQMLESTYMATQSSFFAMVSVAEQFGNLKNTLGSLLGIYAIMRWARRLVAKLSGQPVTGANGITPAGFAKFEATGGAAGPGRGPRPSYKPLLFFLTAVFGLPYLLGRLIKALAAKQEGMYDEHGNLLPGAQMGMGGPGMEGGAEIDPSKLEFCRANFDFVPENPQLELELRKGDLVAVLAKTDPMGNPSQWWRVRTRDGRSGYVPANYLEVIPRPAVEAPKKVEEIGASAVPVN

SEQ ID NO: 107 - protein, 380 aa, Yarrowia lipolytica CLIB122 (GenBank Accession No. CAG79323)
  MISC_FEATURE (1)..(380): YlPex14p
MIPSCLSTQHMAPREDLVQSAVAFLNDPQAATAPLAKRIEFLESKDMTPEEIEEALKRAGSGSAQSHPGSVVSHGGAAPTVPASYAFQSAPPLPERDWKDVFIMATVTVGVGFGLYTVAKRYLMPLILPPTPPSLEADKEALEAEFARVQGLLDQVQQDTEEVKNSQVEVAKRVTDALKGVEETIDQLKSQTKKRDDEMKLVTAEVERIRDRLPKNIDKLKDSQEQGLADIQSELKSLKQLLSTRTAASSGPKLPPIPPPSSYLTRKASPAVPAAAPAPVTPGSPVHNVSSSSTVPADRDDFIPTPAGAVPMIPQPASMSSSSTSTVPNSAISSAPSPIQEPEPFVPEPGNSAVKKPAPKASIPAWQLAALEKEKEKEKE

SEQ ID NO: 108 - protein, 391 aa, Yarrowia lipolytica CLIB122 (GenBank Accession No. CAG79622)
  MISC_FEATURE (1)..(391): YlPex16p
MTDKLVKVMQKKKSAPQTWLDSYDKFLVRNAASIGSIESTLRTVSYVLPGRFNDVEIATETLYAVLNVLGLYHDTIIARAVAASPNAAAVYRPSPHNRYTDWFIKNRKGYKYASRAVTFVKFGELVAEMVAKKNGGEMARWKCIIGIEGIKAGLRIYMLGSTLYQPLCTTPYPDREVTGELLETICRDEGELDIEKGLMDPQWKMPRTGRTIPEIAPTNVEGYLLTKVLRSEDVDRPYNLLSRLDNWGVVAELLSILRPLIYACLLFRQHVNKTVPASTKSKFPFLNSPWAPWIIGLVIEALSRKMMGSWLLRQRQSGKTPTALDQMEVKGRTNLLGWWLFRGEFYQAYTRPLLYSIVARLEKIPGLGLFGALISDYLYLFDRYYFTASTL

SEQ ID NO: 109 - protein, 225 aa, Yarrowia lipolytica CLIB122 (GenBank Accession No. CAG84025)
  MISC_FEATURE (1)..(225): YlPex17p
MSAFPEPSSFEIEFAKQMNRPRTVQFKQLVAVLYIFGGTSALIYIISKTILNPLFEELTFARSEYAIHARRLMEQLNAKLSSMASYIPPVRALQGQRFVDAQTQTEDEEGEDIPNPSLGKSSHVSFGESPMQLKLAEKEKQQKLIDDSVDNLERLADSLKHAGEVSDLSALSGFKYQVEELTNYSDQLAMSGYSMMKSGLPGHETAMSETKKEIRSLKGSVLSVR

SEQ ID NO: 110 - protein, 324 aa, Yarrowia lipolytica (GenBank Accession No. AAK84827)
  MISC_FEATURE (1)..(324): YlPex19p
MSHEEDLDDLDDFLDEFDEQVLSKPPGAQKDATPTTSTAPTTAEAKPDATKKSTETSGTDSKTEGADTADKNAATDSAEAGAEKVSLPNLEDQLAGLKMDDFLKDIEADPESKAQFESLLKEINNVTSATASEKAQQPKSFKETISATADRLNQSNQEMGDMPLGDDMLAGLMEQLSGAGGFGEGGEGDFGDMLGGIMRQLASKEVLYQPLKEMHDNYPKWWDEHGSKVTEEKERDRLKLQQDIVGKICAKFEDPSYSDDSEADRAVITQLMDEMQETGAPPDEIMSNVADGSIPGGLDGLGLGGLGGGKMPEMPENMPECNQQ

SEQ ID NO: 111 - protein, 417 aa, Yarrowia lipolytica CLIB122 (GenBank Accession No. CAG79226)
  MISC_FEATURE (1)..(417): YlPex20p
MASCGPSNALQNLSKHASADRSLQHDRMAPGGAPGAQRQQFRSQTQGGQLNNEFQQFAQAGPAHNSFEQSQMGPHFGQQHFGQPHQPQMGQHAPMAHGQQSDWAQSFSQLNLGPQTGPQHTQQSNWGQDFMRQSPQSHQVQPQMANGVMGSMSGMSSFGPMYSNSQLMNSTYGLQTEHQQTHKTETKSSQDAAFEAAFGAVEESITKTSDKGKEVEKDPMEQTYRYDQADALNRQAEHISDNISREEVDIKTDENGEFASIARQIASSLEEADKSKFEKSTFMNLMRRIGNHEVTLDGDKLVNKEGEDIREEVRDELLREGASQENGFQSEAQQTAPLPVHHEAPPPEQIHPHTETGDKQLEDPMVYIEQEAARRAAESGRTVEEEKLNFYSPFEYAQKLGPQGVAKQSNWEEDYDF

SEQ ID NO: 112 - protein, 195 aa, Yarrowia lipolytica CLIB122 (GenBank Accession No. CAG77876)
  MISC_FEATURE (1)..(195): YlPex22p
VPRCTSHPCNLTLHLPVTTMAPRKTRLPAVIGAAAAAAAVAYLVYSFVAKSNSDQDTFDSSVQSSSKSSTKSPKSTATNSKITVVVSQELVQSQLVDFKHLMSVHPNLVVIVPPMVANKFHRALKSSVGHDHGVKVIRCDTDVGVIHVIKHIRPDLALIADGVGDNIQGEIKRFVGSSEALSGDVNLAAERLTGL

SEQ ID NO: 113 - protein, 386 aa, Yarrowia lipolytica CLIB122 (GenBank Accession No. NC_006072, antisense translation of nucleotides 117230-1183 87)
  MISC_FEATURE (1)..(386): YlPex26p
MPPAMPQMTTSTLLTDSVTSAVNQAATPKVDQMYQTFGESAREFVNKNFYNSYELIRPFFDEITAKGAQQNGSTVLDAENPHNIPLSLWIKVWSLYLAILDASCKQAGEALLNSTGDLSGSDSGEWNQTRKLLARKLTSGSVWDELVTASGGTGNIHPTILALLASLSIRHDTDAKLMADNLEKFIVTYNDNGSDDVKTKTAFYKVLDLYLLRVLPDLGQWDVAHSFVNNTNLFSHEQKKEMTHKLDQSQKHAEQEHKRLLEEAQEKEKSDAKEKEREERVSRDTQSREIKSPIVDSSTSSRDVTRDTTRELSKSSRQPRTLSQIISTSLKSQFDGNAIFRTLALIVIVSLSAANPLIRKRVVDTLKMLWIKILQTLSMGFKVSYL

SEQ ID NO: 114 - DNA, 3387 bp, Yarrowia lipolytica (GenBank Accession No. AB036770)
ggtaccatcaagggtaaaatcaaggctatcatcaagggccatatatcgcaagtttgggggaagataatatgttcatagtgaatcgggttgtggatttcctcatctaacggcattataactagtcctggagggtcttttttatggataacctccatgtacgatgtatccaagatctccacgtactgtgttctgtttcctaagtaatacccaacaacctctccaacaaacacttgggaagatgcacttgtgctgagatgtcaagatgttagagagtagagacagtagcaagcgtaaaaggcggccgaggccaccgagagaacagcgtagcagggcgcgtagtcaccacaggggacgcagaaccaaacaaatgacgaagaagaaccacaaggagacgttttcaaaggcaatgcaaacgaagagggcaatggaaggattgagattagagaactggagactggagtggcgttttcccgatgaacgaacaaacacgcgaagctatgtggaccaacatacaacacggactgaaccaggtttttttatgatttttttactggaaataggtacgtgccaagttggaccatgacactaaacgtgtttaattagtaatattcgtgtaagcgtacattcatttcaaaggttattctttcacggcaaagttataattaaatgaatgtatatgcagaaaaaaaaaaaaaaagtactgtactggatggagagaatattaataaataattgttacccaactacatcttgtcgattgaaagagacccctaagacagataggatatctgcaacccgaggaatgaaccccccagcaccggcaccctttctattaacaaaatgccaactgaaatttgaaaagttcaactaaacttatttgacccacaaaaactcgtcaaaagtggcggcgaaagctggcaaatgatgacatccccttggaaccatgatatcctctcggaatcttcgtccccatttgccacatctacttgcaacgccacatctgcttactaagcaacccaaatctgcctcggctcaaaatgtggggaagttcacatgcattcgctggtgaatctgatctgacactacaactacacaccaggtccaacatgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataatgacgaggtctggatggaaggactagtcagcgagacacagagcatcagggaccagacacgaccaattcaatcgacaacactgtgctgcatagcagtgcacagaggtcctgggcatgaatatattttagcattggagatatgagtggtagagcgtatacagtattaattgtggaggtatctcgtcgcattgatagagcaatacagttactgctgaagggaatgataccgagtatttcggcccgattcagttcttgatatcgtcattttgtctctattgtctacttttcagataacctcaacaaatcttcaacaaatctcccagtaaacagtcagagatcatatccgagatcatatcagatatgtcacgatccgagtacaataatggatattaatctgcttgattttgaattctgttgcgattatgatttctttgatttcgatatgaacacatacggcgactcccagacctttagaagctccagtttggattcttagcaatggttacactcaactatatcccaagtaatacttggtaacaatatgccaagttagtcattcattcgttataggagttagcaagtgtttgtcagctaaaaatggttagtcggtcgattaccacttagatcttttcagcgtggaacttgatggtacgcttgaaccgacacttggagtagtcggggctgttgatgacgtagatgacgtttcgctcagggtgaggagtgcaatagtagtactccttggggccgtctctcagctcaaaggttccatcggcggcaatgtcaaagaccgagccctggagcttgtagccgtagtcgccggtccagaacaaagcctgcagctccagataggcgatgggcatgtcgttaacagagaaggtgttgccctcgccctcggtgatggtgatgggttcgccgtcggtggaggcggtgatcaggtcatcttggtaggtgacgggcagagattcgaccgattgggcgtctgatctggtataggtcagcttgtacttgtctccgacagccgccagagcggtggtagcgacggtgatgagggagatgagtttcatattggcggcaagtttagcaaaagatggcagtgggattgagggacaagagtgtttatatagatatagatacaacacaacgagtctgaatgagacaaccgagacaaccactcccgaagcctcactaatagttactaacggcatatttcaggtacc

SEQ ID NO: 115 - DNA, 1134 bp, Yarrowia lipolytica (GenBank Accession No. AB036770, nucleotides 1038-2171)
  CDS (1)..(1134): Pex10
atgtggggaagttcacatgcattcgctggtgaatctgatctgacactacaactacacaccaggtccaacatgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataa

SEQ ID NO: 116 - protein, 377 aa, Yarrowia lipolytica (GenBank Accession No. AB036770, nucleotides 1038-2171); identical to SEQ ID NO: 104

SEQ ID NO: 117 - DNA, 1065 bp, Yarrowia lipolytica (GenBank Accession No. AJ012084, which corresponds to nucleotides 1107-2171 of GenBank Acc ession No. AB036770)
  CDS (1)..(1065): YlPEX10
atgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataa

SEQ ID NO: 118 - protein, 354 aa, Yarrowia lipolytica (GenBank Accession No. AJ012084, which corresponds to nucleotides 1107-2171 of GenBank Acc ession No. AB036770)
MSDNTTIKKPIRPKPIRTERLPYAGAAEIIRANQKDHYFESVLEQHLVTFLQKWKGVRFIHQYKEELETASKFAYLGLCTLVGSKTLGEEYTNLMYTIRDRTALPGVVRRFGYVLSNTLFPYLFVRYMGKLRAKLMREYPHLVEYDEDEPVPSPETWKERVIKTFVNKFDKFTALEGFTAIHLAIFYVYGSYYQLSKRIWGMRYVFGHRLDKNEPRIGYEMLGLLIFARFATSFVQTGREYLGALLEKSVEKEAGEKEDEKEAVVPKKKSSIPFIEDTEGETEDKIDLEDPRQLKFIPEASRACTLCLSYISAPACTPCGHFFCWDCISEWVREKPECPLCRQGVREQNLLPIR

SEQ ID NO: 119 - protein, 38 aa, Yarrowia lipolytica
  misc_feature (2)..(3): Xaa can be any naturally occurring amino acid
  misc_feature (5)..(15): Xaa can be any naturally occurring amino acid
  misc_feature (17)..(17): Xaa can be any naturally occurring amino acid
  misc_feature (19)..(20): Xaa can be any naturally occurring amino acid
  misc_feature (22)..(23): Xaa can be any naturally occurring amino acid
  misc_feature (25)..(34): Xaa can be any naturally occurring amino acid
  misc_feature (36)..(37): Xaa can be any naturally occurring amino acid
CXXCXXXXXXXXXXXCXHXXCXXCXXXXXXXXXXCXXC

SEQ ID NO: 120 - protein, 345 aa, Yarrowia lipolytica
MWGSSHAFAGESDLTLQLHTRSNMSDNTTIKKPIRPKPIRTERLPYAGAAEIIRANQKDHYFESVLEQHLVTFLQKWKGVRFIHQYKEELETASKFAYLGLCTLVGSKTLGEEYTNLMYTIRDRTALPGVVRRFGYVLSNTLFPYLFVRYMGKLRAKLMREYPHLVEYDEDEPVPSPETWKERVIKTFVNKFDKFTALEGFTAIHLAIFYVYGSYYQLSKRIWGMRYVFGHRLDKNEPRIGYEMLGLLIFARFATSFVQTGREYLGALLEKSVEKEAGEKEDEKEAVVPKKKSSIPFIEDTEGETEDKIDLEDPRQLKFIPEASRACTLCLSYISAPACTPCGHF

SEQ ID NO: 121 - DNA, 2987 bp, Yarrowia lipolytica
  misc_feature: mutant acetohydroxyacid synthase (AHAS) with W497L mutation
  ref <302>: TITLE: HIGH EICOSAPENTAENOIC ACID PRODUCING STRAINS OF YARROWIA LIPOLYTICA
  ref <310>: PATENT DOCUMENT NUMBER: US 2006-0115881-A1
  ref <311>: PATENT FILING DATE: 2005-11-02
  ref <312>: PUBLICATION DATE: 2006-06-01
  ref <313>: RELEVANT RESIDUES IN SEQ ID NO: (1)..(2987)
  ref <302>: TITLE: HIGH EICOSAPENTAENOIC ACID PRODUCING STRAINS OF YARROWIA LIPOLYTICA
  ref <310>: PATENT DOCUMENT NUMBER: WO 2006/052870
  ref <311>: PATENT FILING DATE: 2005-11-03
  ref <312>: PUBLICATION DATE: 2006-05-18
  ref <313>: RELEVANT RESIDUES IN SEQ ID NO: (1)..(2987)
ttccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctc

SEQ ID NO: 122 - protein, 449 aa, Euglena gracilis
  MISC_FEATURE (34)..(34): Xaa = Gly (G) or His (H)
MALSLTTEQLLERPDLVAIDGILYDLEGLAKVHXGGDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 123 - DNA, 34 bp, Escherichia coli
ataacttcgtataatgtatgctatacgaagttat

SEQ ID NO: 124 - protein, 449 aa, Euglena gracilis
MALSLTTEQLLERPDLVAIDGILYDLEGLAKVHPGSDLILASGASDASPLFYSMHPYVKPENSKLLQQFVRGKHDRTSKDIVYTYDSPFAQDVKRTMREVMKGRNWYATPGFWLRTVGIIAVTAFCEWHWATTGMVLWGLLTGFMHMQIGLSIQHDASHGAISKKPWVNALFAYGIDVIGSSRWIWLQSHIMRHHTYTNQHGLDLDAESAEPFLVFHNYPAANTARKWFHRFQAWYMYLVLGAYGVSLVYNPLYIFRMQHNDTIPESVTAMRENGFLRRYRTLAFVMRAFFIFRTAFLPWYLTGTSLLITIPLVPTATGAFLTFFFILSHNFDGSERIPDKNCKVKSSEKDVEADQIDWYRAQVETSSTYGGPIAMFFTGGLNFQIEHHLFPRMSSWHYPFVQQAVRECCERHGVRYVFYPTIVGNIISTLKYMHKVGVVHCVKDAQDS

SEQ ID NO: 125 - protein, 454 aa, Euglena anabaena UTEX 373
MATISLTTEQLLEHPELVAIDGVLYDLFGLAKVHCGGNLIEAAGASDGTALFYSMHPGVKPENSKLLQQFARGKHERSSKDPVYTFDSPFAQDVKQSVREVMKGRNWYATPGFWLRTALIIACTAIGEWYWITTGAVMWGIFTGYFHSQIGLAIQHDASHGAISKKPWVNAFFAYGIDAIGSSRWIWLQSHIMRHHTYTNQHGLDLDAASAEPFILFHSYPATNASRKWYHRFQAWYMYIVLGMYGVSMVYNPMYLFTMQHNDTIPEATSLRPGSFFNRQRAFAVSLRLLFIFRNAFLPWYIAGASPLLTILLVPTVTGIFLTFVFVLSHNFEGAERTPEKNCKAKRAKEGKEVRDVEEDRVDWYRAQAETAATYGGSVGMMLTGGLNLQIEHHLFPRMSSWHYPFIQDTVRECCKRHGVRYTYYPTILENIMSTLRYMQKVGVAHTIQDAQEF

SEQ ID NO: 126 - protein, 463 aa, Peridinium sp. CCMP626
  MISC_FEATURE (55)..(55): Xaa = Cys (C) or Trp (W)
MAPDADKLRQRKAQSIQDTADSQATELKIGTLKGLQGTEIVIDGDIYDIKDFDHXGGESIMTFGGNDVTATYKMIHPYHSKHHLEKMKKVGRVPDYTSEYKFDTPFEREIKQEVFKIVRRGREFGTPGYFFRAFCYIGLFFYLQYLWVTTPTTFALAIFYGVSQAFIGLNVQHDANHGAASKKPWINNLLGLGADFIGGSKWLWMNQHWTHHTYTNHHEKDPDALGAEPMLLFNDYPLGHPKRTLIHHFQAFYYLFVLAGYWVSSVFNPQILDLQHRGAQAVGMKMENDYIAKSRKYAIFLRLLYIYTNIVAPIQNQGFSLTVVAHILTMGVASSLTLATLFALSHNFENADRDPTYEARKGGEPVCWFKSQVETSSTYGGFISGCLTGGLNFQVEHHLFPRMSSAWYPYIAPTVREVCKKHGVKYAYYPWVWQNLISTVKYLHQSGTGSNWKNGANPYSGKL

SEQ ID NO: 127 - DNA, 13066 bp, Artificial Sequence
  Plasmid pZP3-Pa777U
tctcggtctattcttttgatttataagggattttgccgatttcggcctattggttaaaaaatgagctgatttaacaaaaatttaacgcgaattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcgcgccaccaatcacaattctgaaaagcacatcttgatctcctcattgcggggagtccaacggtggtcttattcccccgaatttcccgctcaatctcgttccagaccgacccggacacagtgcttaacgccgttccgaaactctaccgcagatatgctccaacggactgggctgcatagatgtgatcctcggcttggagaaatggataaaagccggccaaaaaaaaagcggaaaaaagcggaaaaaaagagaaaaaaaatcgcaaaatttgaaaaatagggggaaaagacgcaaaaacgcaaggaggggggagtatatgacactgataagcaagctcacaacggttcctcttatttttttcctcatcttctgcctaggttcccaaaatcccagatgcttctctccagtgccaaaagtaagtaccccacaggttttcggccgaaaattccacgtgcagcaacgtcgtgtggggtgttaaaatgtggggggggggaaccaggacaagaggctcttgtgggagccgaatgagagcacaaagcgggcgggtgtgataagggcatttttgcccattttcccttctcctgtctctccgacggtgatggcgttgtgcgtcctctatttctttttatttctttttgttttatttctctgactaccgatttggtttgatttcctcaaccccacacaaataagctcgggccgaggaatatatatatacacggacacagtcgccctgtggacaacacgtcactacctctacgatacacaccgtacgttgtgtggaagcttgtgagcggataacaatttcacacaggaaacagctatgaccatgattacgccaagctcgaaattaaccctcactaaagggaacaaaagctggagctccaccgcggacacaatatctggtcaaatttcagtttcgttacatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttagttggctttggtcttggcagccttggcctccttgagggtaaacatcttggcatccttgtcgaccacgccgtacttggcgtacataagaccaattcggatgaaggtgggaatgatgggagaagccgactttcgcaccagttcgggaaaggcctgagcgaaggcagcagtggcctcgttgagcttgtagtgaggaatgatgggaaacagatggtggatctgatgtgtaccaatgttgtgggacaggttgtcgatgagggctccgtagcttcggtccacagaggacaagttgcccttgacataggtccactccgaatcggcgtaccagggagtttcctcgtcgttgtgatggaggaaggtagtgacaaccagcatggtggcgaatccaaagagaggtgcgaagtaatacagagccatggtcttgaggccgtagacgtaggtaaggtaggcgtacagaccagcaaaggccacgagagagccgagggaaatgatgacggcagacattcttcgcaggtagagaggctcccagggattgaagtggttgacctttcggggaggaaatccagcaacgaggtaggcaaaccaagccgaaccaagggagatgaccatgtgtcgggacaggggatgagagtcggcttctcgctgagggtagaagatctcatccttgtcgatgttgccggtgttcttgtgatggtgtcgatggctgatcttccacgactcgtagggagtcagaatgatggagtgaatgagtgtgccaacagagaagttgagcaggtgggatcgcgagaaggcaccatgtccacagtcgtgaccgatggtaaagaatccccagaacacgataccctggagcagaatgtagccagtgcaaaggacggcatcgagcagtgcaaactcctgcacgatagcaagggctcgagcatagtacagtccgagagcaagggaaccggcaatgcccagagctcgcacggtatagtagagggaccagggaacagaggcttcgaagcagtgggcaggcagggatcgcttgatctcggtgagagtagggaactcgtagggagcggcaacggtagaggaagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatcgattgttgtctactaactatcgtacgataacttcgtatagcatacattatacgaagttatcgcgtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagctaacgtccacaagtccgcctttgccgctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcattgctggcctgcgagctggtgccgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttattctcaactacatccccagtcacaataccaccactgcactaccactacaccaaaaccatgatcaaaccacccatggacttcctggaggcagaagaacttgttatggaaaagctcaagagagagatcataacttcgtatagcatacattatacgaagttatcctgcaggtaaaggaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcattgatgattggaaacacacacatgggttatatctaggtgagagttagttggacagttatatattaaatcagctatgccaacggtaacttcattcatgtcaacgaggaaccagtgactgcaagtaatatagaatttgaccaccttgccattctcttgcactcctttactatatctcatttatttcttatatacaaatcacttcttcttcccagcatcgagctcggaaacctcatgagcaataacatcgtggatctcgtcaatagagggctttttggactccttgctgttggccaccttgtccttgctgtttaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggcttcttccactgttgctgcgccgtacgagttcccgacgctgacggagatcaagcgctcgctgccagcgcactgctttgaggcctcggtcccgtggtcgctctactacaccgtgcgcgcgctgggcatcgccggctcgctcgcgctcggcctctactacgcgcgcgcgctcgcgatcgtgcaggagtttgccctgctggatgcggtgctctgcacggggtacattctgctgcagggcatcgtattctgggggttcttcaccatcggccatgactgcggccacggcgcgttctcgcgttcgcacctgctcaacttcagcgtcggcacgctcattcactcgatcatcctcacgccgtacgagtcatggaagatctcgcaccgccaccaccacaagaacacgggcaacatcgacaaggacgagattttctacccgcagcgcgaggccgactcgcacccactgtcccgacacatggtgatctcgctcggctcggcctggttcgcgtacctcgttgcgggcttccctcctcgcaaggtgaaccacttcaacccttgggaaccgttgtacctgcgccgcatgtctgccgtcatcatctcactcggctcgctcgtggcgttcgcgggcttgtatgcgtatctcacctacgtctatggccttaagaccatggcgctgtactacttcgcccctctctttgggttcgccacgatgctcgtggtcactacctttttgcaccacaatgacgaggaaacgccatggtacgccgactcggagtggacgtacgtcaagggcaacctctcgtccgtggaccgctcgtacggcgcgctcatcgacaacctgagccacaacatcggcacgcaccagatccaccacctgtttccgatcatcccgcactacaagctgaacgaggcgacggcagcgttcgcgcaggcgttcccggagctcgtgcgcaagagcgcgtcgccgatcatcccgacgttcatccgcatcgggctcatgtacgccaagtacggcgtcgtggacaaggacgccaagatgtttacgctcaaggaggccaaggccgccaagaccaaggccaactaggcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaagatgacgacatttgcgagctggacgaggaatagatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaattttcccataggtgtgctacaaggtgttgagatgtggtacagtaccaccatgattcgaggtaaagagcccagaagtcattgatgaggtcaagaaatacacagatctacagctcaatacaatgaatatcttctttcatattcttcaggtgacaccaagggtgtctattttccccagaaatgcgtgaaaaggcgcgtgtgtagcgtggagtatgggttcggttggcgtatccttcatatatcgacgaaatagtagggcaagagatgacaaaaagtatctatatgtagacagcgtagaatatggatttgattggtataaattcatttattgcgtgtctcacaaatactctcgataagttggggttaaactggagatggaacaatgtcgatatctcgacgcatgcgacgtcgggcccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaacccta

SEQ ID NO: 128 - DNA, 9570 bp, Artificial Sequence
  Plasmid pY117
ggccgccaccgcggcccgagattccggcctcttcggccgccaagcgacccgggtggacgtctagaggtacctagcaattaacagatagtttgccggtgataattctcttaacctcccacactcctttgacataacgatttatgtaacgaaactgaaatttgaccagatattgtgtccgcggtggagctccagcttttgttccctttagtgagggtttaaacgagcttggcgtaatcatggtcatagctgtttcctgtgtgaaattgttatccgctcacaattccacacaacgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaaccgatttcgacagtaattaattaattccctagtcccagtgtacacccgccgatatcgcttaccctgcagccggattaaggttggcaatttttcacgtccttgtctccgcaattactcaccgggtggtttataagattgcaagcgtcttgatttgtctctgtatactaacatgcaatcgcgactcgcccgacgggccactaacctggccagaatctccagatccaagtattctcttggtctgcgatatgtttccaacacaaaagcccctgctgcccagccggcaactgctgagtgagtattccttgccataaacgacccagaaccactgtatagtgtttggaagcactagtcagaagaccagcgaaaacaggtggaaaaaactgagacgaaaagcaacgaccagaaatgtaatgtgtggaaaagcgacacacacagagcagataaagaggtgacaaataacgacaaatgaaatatcagtatcttcccacaatcactacctctcagctgtctgaaggtgcggctgatatatccatcccacgtctaacgtatggagtgtgatagaatatgacgacacaagcatgagaactcgctctctatccaaccaccgaaacactgtcactacagccgttcttgttgctccattcgcttttgtgattccatgccttctctggtgactgacaacattccttccttttctccagccctgttgttatctgctcatgacctacggccactctctatcgcatactaacatagacgatcccagcccgctccccacttccagggcaccgttggcaagcctcctatcctcaagaaggctgaggctgccaacgctgacatggacgagtccttcatcggaatgtctggaggagagatcttccacgagatgatgctgcgacacaacgtcgacactgtcttcggttaccccggtggagccattctccccgtctttgacgccattcacaactctgagtacttcaactttgtgctccctcgacacgagcagggtgccggccacatggccgagggctacgctcgagcctctggtaagcccggtgtcgttctcgtcacctctggccccggtgccaccaacgtcatcacccccatgcaggacgctctttccgatggtacccccatggttgtcttcaccggtcaggtcctgacctccgttatcggcactgacgccttccaggaggccgatgttgtcggcatctcccgatcttgcaccaagtggaacgtcatggtcaagaacgttgctgagctcccccgacgaatcaacgaggcctttgagattgctacttccggccgacccggtcccgttctcgtcgatctgcccaaggatgttactgctgccatcctgcgagagcccatccccaccaagtccaccattccctcgcattctctgaccaacctcacctctgccgccgccaccgagttccagaagcaggctatccagcgagccgccaacctcatcaaccagtccaagaagcccgtcctttacgtcggacagggtatccttggctccgaggagggtcctaagctgcttaaggagctggctgagaaggccgagattcccgtcaccactactctgcagggtcttggtgcctttgacgagcgagaccccaagtctctgcacatgctcggtatgcacggttccggctacgccaacatggccatgcagaacgctgactgtatcattgctctcggcgcccgatttgatgaccgagttaccggctccatccccaagtttgcccccgaggctcgagccgctgcccttgagggtcgaggtggtattgttcactttgagatccaggccaagaacatcaacaaggttgttcaggccaccgaagccgttgagggagacgttaccgagtctgtccgacagctcatccccctcatcaacaaggtctctgccgctgagcgagctccctggactgagactatccagtcctggaagcagcagttccccttcctcttcgaggctgaaggtgaggatggtgttatcaagccccagtccgtcattgctctgctctctgacctgacagagaacaacaaggacaagaccatcatcaccaccggtgttggtcagcatcagatgtggactgcccagcatttccgatggcgacaccctcgaaccatgatcacttctggtggtcttggaactatgggttacggcctgcccgccgctatcggcgccaaggttgcccgacctgactgcgacgtcattgacatcgatggtgacgcttctttcaacatgactctgaccgagctgtccaccgccgttcagttcaacattggcgtcaaggctattgtcctcaacaacgaggaacagggtatggtcacccagctgcagtctctcttctacgagaaccgatactgccacactcatcagaagaaccccgacttcatgaagctggccgagtccatgggcatgaagggtatccgaatcactcacattgaccagctggaggccggtctcaaggagatgctcgcatacaagggccctgtgctcgttgaggttgttgtcgacaagaagatccccgttcttcccatggttcccgctggtaaggctttgcatgagttccttgtctacgacgctgacgccgaggctgcttctcgacccgatcgactgaagaatgcccccgcccctcacgtccaccagaccacctttgagaactaagtggaaaggaacacaagcaatccgaaccaaaaataattggggtcccgtgcccacagagtctagtgcagacctaaaatgaccacagtaaattatagctgttattaaacatgagattttgaccaacaagagcgtaggaatgttattagctactacttgtacatacacagcatttgttttaaataatgttgcctccaggggcagtgagatcaggacccagatccgtggccagctctctgacttcagaccgcttgtacttaagcagctcgcaacactgttgtcgaggattgaacttgccatattcgattttgtggtcatgaatccagcacacctcatttaaatgtagctaacggtagcaggcgaactactggtacatacctcccccggaatatgtacaggcataatgcgtatctgtgggacatgtggtcgttgcgccattatgtaagcagcgtgtactcctctgactgtccatatggtttgctccatctcaccctcatcgttttcattgttcacaggcggccacaaaaaaactgtcttctctccttctctcttcgccttagtctactcggaccagttttagtttagcttggcgccactggataaatgagacctcaggccttgtgatgaggaggtcacttatgaagcatgttaggaggtgcttgtatggatagagaagcacccaaaataataagaataataataaaacagggggcgttgtcatttcatatcgtgttttcaccatcaatacacctccaaacaatgcccttcatgtggccagccccaatattgtcctgtagttcaactctatgcagctcgtatcttattgagcaagtaaaactctgtcagccgatattgcccgacccgcgacaagggtcaacaaggtggtgtaaggccttcgcagaagtcaaaactgtgccaaacaaacatctagagtctctttggtgtttctcgcatatatttwatcggctgtcttacgtatttgcgcctcggtaccggactaatttcggatcatccccaatacgctttttcttcgcagctgtcaacagtgtccatgatctatccacctaaatgggtcatatgaggcgtataatttcgtggtgctgataataattcccatatatttgacacaaaacttccccccctagacatacatctcacaatctcacttcttgtgcttctgtcacacatctcctccagctgacttcaactcacacctctgccccagttggtctacagcggtataaggtttctccgcatagaggtgcaccactcctcccgatacttgtttgtgtgacttgtgggtcacgacatatatatctacacacattgcgccaccctttggttcttccagcacaacaaaaacacgacacgctaaccatggccaatttactgaccgtacaccaaaatttgcctgcattaccggtcgatgcaacgagtgatgaggttcgcaagaacctgatggacatgttcagggatcgccaggcgttttctgagcatacctggaaaatgcttctgtccgtttgccggtcgtgggcggcatggtgcaagttgaataaccggaaatggtttcccgcagaacctgaagatgttcgcgattatcttctatatcttcaggcgcgcggtctggcagtaaaaactatccagcaacatttgggccagctaaacatgcttcatcgtcggtccgggctgccacgaccaagtgacagcaatgctgtttcactggttatgcggcggatccgaaaagaaaacgttgatgccggtgaacgtgcaaaacaggctctagcgttcgaacgcactgatttcgaccaggttcgttcactcatggaaaatagcgatcgctgccaggatatacgtaatctggcatttctggggattgcttataacaccctgttacgtatagccgaaattgccaggatcagggttaaagatatctcacgtactgacggtgggagaatgttaatccatattggcagaacgaaaacgctggttagcaccgcaggtgtagagaaggcacttagcctgggggtaactaaactggtcgagcgatggatttccgtctctggtgtagctgatgatccgaataactacctgttttgccgggtcagaaaaaatggtgttgccgcgccatctgccaccagccagctatcaactcgcgccctggaagggatttttgaagcaactcatcgattgatttacggcgctaaggatgactctggtcagagatacctggcctggtctggacacagtgcccgtgtcggagccgcgcgagatatggcccgcgctggagtttcaataccggagatcatgcaagctggtggctggaccaatgtaaatattgtcatgaactatatccgtaacctggatagtgaaacaggggcaatggtgcgcctgctggaagatggcgattaagc

SEQ ID NO: 129 - DNA, 15743 bp, Artificial Sequence
  Plasmid pZP2-2988
ggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttaaacagtgtacgcagtactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacaccatggaggtcgtgaacgaaatcgtctccattggccaggaggttcttcccaaggtcgactatgctcagctctggtctgatgcctcgcactgcgaggtgctgtacctctccatcgccttcgtcatcctgaagttcacccttggtcctctcggacccaagggtcagtctcgaatgaagtttgtgttcaccaactacaacctgctcatgtccatctactcgctgggctccttcctctctatggcctacgccatgtacaccattggtgtcatgtccgacaactgcgagaaggctttcgacaacaatgtcttccgaatcaccactcagctgttctacctcagcaagttcctcgagtacattgactccttctatctgcccctcatgggcaagcctctgacctggttgcagttctttcaccatctcggagctcctatggacatgtggctgttctacaactaccgaaacgaagccgtttggatctttgtgctgctcaacggcttcattcactggatcatgtacggctactattggacccgactgatcaagctcaagttccctatgcccaagtccctgattacttctatgcagatcattcagttcaacgttggcttctacatcgtctggaagtaccggaacattccctgctaccgacaagatggaatgagaatgtttggctggtttttcaactacttctacgttggtactgtcctgtgtctgttcctcaacttctacgtgcagacctacatcgtccgaaagcacaagggagccaaaaagattcagtgagcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgggcgtcgttgcttgtgtgatttttgaggacccatccctttggtatataagtatactctggggttaaggttgcccgtgtagtctaggttatagttttcatgtgaaataccgagagccgagggagaataaacgggggtatttggacttgtttttttcgcggaaaagcgtcgaatcaaccctgcgggccttgcaccatgtccacgacgtgtttctcgccccaattcgccccttgcacgtcaaaattaggcctccatctagacccctccataacatgtgactgtggggaaaagtataagggaaaccatgcaaccatagacgacgtgaaagacggggaggaaccaatggaggccaaagaaatggggtagcaacagtccaggagacagacaaggagacaaggagagggcgcccgaaagatcggaaaaacaaacatgtccaattggggcagtgacggaaacgacacggacacttcagtacaatggaccgaccatctccaagccagggttattccggtatcaccttggccgtaacctcccgctggtacctgatattgtacacgttcacattcaatatactttcagctacaataagagaggctgtttgtcgggcatgtgtgtccgtcgtatggggtgatgtccgagggcgaaattcgctacaagcttaactctggcgcttgtccagtatgaatagacaagtcaagaccagtggtgccatgattgacagggaggtacaagacttcgatactcgagcattactcggacttgtggcgattgaacagacgggcgatcgcttctcccccgtattgccggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcgctgatgacactttggtctgaaagagatgcattttgaatcccaaacttgcagtgcccaagtgacatacatctccgcgttttggaaaatgttcagaaacagttgattgtgttggaatggggaatggggaatggaaaaatgactcaagtatcaattccaaaaacttctctggctggcagtacctactgtccatactactgcattttctccagtcaggccactctatactcgacgacacagtagtaaaacccagataatttcgacataaacaagaaaacagacccaataatatttatatatagtcagccgtttgtccagttcagactgtaatagccgaaaaaaaatccaaagtttctattctaggaaaatatattccaatatttttaattcttaatctcatttattttattctagcgaaatacatttcagctacttgagacatgtgatacccacaaatcggattcggactcggttgttcagaagagcatatggcattcgtgctcgcttgttcacgtattcttcctgttccatctcttggccgacaatcacacaaaaatggggttttttttttaattctaatgattcattacagcaaaattgagatatagcagaccacgtattccataatcaccaaggaagttcttgggcgtcttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctacatttctcccttgctccaactatttaaattccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatcccctttgagtactcgtcttggcttctctccgagcagtatgaggctctctaatctagcgcatttaatatctcaatgtatttatatatttatcttctcatgcggccgcttactgagccttggcaccgggctgcttctcggccattcgagcgaactgggacaggtatcggagcaggatgacgagaccttcatggggcagagggtttcggtaggggaggttgtgcttctggcacagctgttccacctggtaggaaacggcagtgaggttgtgtcgaggcagggtgggccagagatggtgctcgatctggtagttcaggcctccaaagaaccagtcagtaatgatgcctcgtcgaatgttcatggtctcatggatctgacccacagagaagccatgtccgtcccagacggaatcaccgatcttctccagagggtagtggttcatgaagaccacgatggcaattccgaagccaccgacgagctcggaaacaaagaacaccagcatcgaggtcaggatggagggcataaagaagaggtggaacagggtcttgagagtccagtgcagagcgagtccaatggcctctttcttgtactgagatcggtagaactggttgtctcggtccttgagggatcgaacggtcagcacagactggaaacaccagatgaatcgcaggagaatacagatgaccaggaaatagtactgttggaactgaatgagctttcgggagatgggagaagctcgagtgacatcgtcctcggaccaggcgagcagaggcaggttatcaatgtcgggatcgtgaccctgaacgttggtagcagaatgatgggcgttgtgtctgtccttccaccaggtcacggagaagccctggagtccgttgccaaagaccagacccaggacgttattccagtttcggttcttgaaggtctggtggtggcagatgtcatgagacagccatcccatttgctggtagtgcataccgagcacgagagcaccaatgaagtacaggtggtactggaccagcatgaagaaggcaagcacgccaagacccagggtggtcaagatcttgtacgagtaccagaggggagaggcgtcaaacatgccagtggcgatcagctcttctcggagctttcggaaatcctcctgagcttcgttgacggcagcctggggaggcagctcggaagcctggttgatcttgggcattcgcttgagcttgtcgaaggcttcctgagagtgcataaccatgaaggcgtcagtagcatctcgtccctggtagttctcaatgatttcagctccaccagggtggaagttcacccaagcggagacgtcgtacacctttccgtcgatgacgaggggcagagcctgtcgagaagccttcaccatgggcaggacctgtgttagtacattgtcggggagtcatcaattggttcgacaggttgtcgactgttagtatgagctcaattgggctctggtgggtcgatgacacttgtcatctgtttctgttgggtcatgtttccatcaccttctatggtactcacaattcgtccgattcgcccgaatccgttaataccgactttgatggccatgttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgataacgtctcgtaccaaccacagattacgacccattcgcagtcacagttcactagggtttgggttgcatccgttgagagcggtttgtttttaaccttctccatgtgctcactcaggttttgggttcagatcaaatcaaggcgtgaaccactttgtttgaggacaaatgtgacacaaccaaccagtgtcaggggcaagtccgtgacaaaggggaagatacaatgcaattactgacagttacagactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggcggaacgagcttagtcttcaattgaggtgcgagcgacacaattgggtgtcacgtggcctaattgacctcgggtcgtggagtccccagttatacagcaaccacgaggtgcatgggtaggagacgtcaccagacaatagggttttttttggactggagagggttgggcaaaagcgctcaacgggctgtttggggagctgtgggggaggaattggcgatatttgtgaggttaacggctccgatttgcgtgttttgtcgctcctgcatctccccatacccatatcttccctccccacctctttccacgataattttacggatcagcaataaggttccttctcctagtttccacgtccatatatatctatgctgcgtcgtccttttcgtgacatcaccaaaacacatacaacaatggctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaagc

SEQ ID NO: 130 - DNA, 6303 bp, Artificial Sequence
  Plasmid pZKUE3S
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaattaatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgcatgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtttaaacccggaaccggaatcgataagcttgatatcgaattcatgctgttcatcgtggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacaccatggagtctggacccatgcctgctggcattcccttccctgagtactatgacttctttatggactggaagactcccctggccatcgctgccacctacactgctgccgtcggtctcttcaaccccaaggttggcaaggtctcccgagtggttgccaagtcggctaacgcaaagcctgccgagcgaacccagtccggagctgccatgactgccttcgtctttgtgcacaacctcattctgtgtgtctactctggcatcaccttctactacatgtttcctgctatggtcaagaacttccgaacccacacactgcacgaagcctactgcgacacggatcagtccctctggaacaacgcacttggctactggggttacctcttctacctgtccaagttctacgaggtcattgacaccatcatcatcatcctgaagggacgacggtcctcgctgcttcagacctaccaccatgctggagccatgattaccatgtggtctggcatcaactaccaagccactcccatttggatctttgtggtcttcaactccttcattcacaccatcatgtactgttactatgccttcacctctatcggattccatcctcctggcaaaaagtacctgacttcgatgcagattactcagtttctggtcggtatcaccattgccgtgtcctacctcttcgttcctggctgcatccgaacacccggtgctcagatggctgtctggatcaacgtcggctacctgtttcccttgacctatctgttcgtggactttgccaagcgaacctactccaagcgatctgccattgccgctcagaaaaaggctcagtaagc

SEQ ID NO: 131 - DNA, 15812 bp, Artificial Sequence
  Plasmid pZKL2-5U89GC
gtacgttatcatttgaacagtgaaaggctacagtaacagaagcagttgtaaacttcattccgttgattctgtactacagtaccccactacgccgcttccgctgacactgttcaacccaaaaactacatctgcgtgcgctgtgtaaggctatcatcagatacatactgtagattctgtagatgcgaacctgcttgtatcatatacatccccctccccctgacctgcacaagcaagcaatgtgacattgatattgctgcttatctagtgccgaggatgtgaaagccgagactcaaacatttcttttactctcttgttcctgaccagacctggcggagattacgccagtatgattcttgcaggtctgagacaagcctggaacagccaacatttatttttcgaagcgagaaacatgccacaccccggcacgttcagagatgcatatgatttgtttttcgagtaacagtacccccccccccccccccaatgaaaccagtattactcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgctggtttcgatttgtcttagaggaacgcatatacagtaatcatagagaataaacgatattcatttattaaagtagatagttgaggtagaagttgtaaagagtgataaatagcttagataccacagacaccctcggtgacgaagtactgcagatggtttccaatcacattgacctgctggagcagagtgttaccggcagagcactgtttattgctctggccctggcacatgacaacgttggagagaggagggtggatcaggggccagtcaataaagacctcaccagagcagtgctggtaaccgtcccagaagggcacttgagggacgatatctcctcggtgggtgattcggtagagctttcggtctttggacaccttggagacatcggggttctcctggccaaagaagagtttatcgacccagttagcaaagccagcgttaccgacaatgggctgaccaagagtaacaacgaggggatcgtggccgttaaccttgaggttgattccgaacagaagggctgcagctcctccgagagagtgaccggtgacagcaatctggtagtcgggatactgctcaatcacagagtcgagcttggggccgatctgattgtaggtgttgttgtaggactggatgaagccattgtggacaagacagtcatcacaagtagcagtagaagagatgttagcagcaagatcaaagttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcgcctccgggatggaccttggcaagaccttccagatcgtagagaatgccgtcgatggcaaccaggtcgggtcgctcgagcagctgctcggtagtaagggagagagccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgatgtgtgtttaattcaagaatgaatatagagaagagaagaagaaaaaagattcaattgagccggcgatgcagacccttatataaatgttgccttggacagacggagcaagcccgcccaaacctacgttcggtataatatgttaagctttttaacacaaaggtttggcttggggtaacctgatgtggtgcaaaagaccgggcgttggcgagccattgcgcgggcgaatggggccgtgactcgtctcaaattcgagggcgtgcctcaattcgtgcccccgtggctttttcccgccgtttccgccccgtttgcaccactgcagccgcttctttggttcggacaccttgctgcgagctaggtgccttgtgctacttaaaaagtggcctcccaacaccaacatgacatgagtgcgtgggccaagacacgttggcggggtcgcagtcggctcaatggcccggaaaaaacgctgctggagctggttcggacgcagtccgccgcggcgtatggatatccgcaaggttccatagcgccattgccctccgtcggcgtctatcccgcaacctctaaatagagcgggaatataacccaagcttcttttttttcctttaacacgcacacccccaactatcatgttgctgctgctgtttgactctactctgtggaggggtgctcccacccaacccaacctacaggtggatccggcgctgtgattggctgataagtctcctatccggactaattctgaccaatgggacatgcgcgcaggacccaaatgccgcaattacgtaaccccaacgaaatgcctacccctctttggagcccagcggccccaaatccccccaagcagcccggttctaccggcttccatctccaagcacaagcagcccggttctaccggcttccatctccaagcacccctttctccacaccccacaaaaagacccgtgcaggacatcctactgcgtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaac

SEQ ID NO: 132 - DNA, 15877 bp, Artificial Sequence
  Plasmid pZKL1-2SP98C
aaatgatgtcgacgcagtaggatgtcctgcacgggtctttttgtggggtgtggagaaaggggtgcttggatcgatggaagccggtagaaccgggctgcttgtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaagaagcttgggttatattcccgctctatttagaggttgcgggatagacgccgacggagggcaatggcgctatggaaccttgcggatatccatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaccatgggcgtattcattaaacaggagcagcttccggctctcaagaagtacaagtactccgccgaggatcactcgttcatctccaacaacattctgcgccccttctggcgacagtttgtcaaaatcttccctctgtggatggcccccaacatggtgactctgctgggcttcttctttgtcattgtgaacttcatcaccatgctcattgttgatcccacccacgaccgcgagcctcccagatgggtctacctcacctacgctctgggtctgttcctttaccagacatttgatgcctgtgacggatcccatgcccgacgaactggccagagtggaccccttggagagctgtttgaccactgtgtcgacgccatgaatacctctctgattctcacggtggtggtgtccaccacccatatgggatataacatgaagctactgattgtgcagattgccgctctcggaaacttctacctgtcgacctgggagacctaccataccggaactctgtacctttctggcttctctggtcctgttgaaggtatcttgattctggtggctcttttcgtcctcaccttcttcactggtcccaacgtgtacgctctgaccgtctacgaggctcttcccgagtccatcacttcgctgctgcctgccagcttcctggacgtcaccatcacccagatctacattggattcggagtgctgggcatggtgttcaacatctacggcgcctgcggaaacgtgatcaagtactacaacaacaagggcaagagcgctctccccgccattctcggaatcgccccctttggcatcttctacgtcggcgtctttgcctgggcccatgttgctcctctgcttctctccaagtacgccatcgtctatctgtttgccattggggctgcctttgccatgcaagtcggccagatgattcttgcccatctcgtgcttgctccctttccccactggaacgtgctgctcttcttcccctttgtgggactggcagtgcactacattgcacccgtgtttggctgggacgccgatatcgtgtcggttaacactctcttcacctgttttggcgccaccctctccatttacgccttctttgtgcttgagatcatcgacgagatcaccaactacctcgatatctggtgtctgcgaatcaagtaccctcaggagaagaagaccgaataagcggccgcatggagcgtgtgttctgagtcgatgttttctatggagttgtgagtgttagtagacatgatgggtttatatatgatgaatgaatagatgtgattttgatttgcacgatggaattgagaactttgtaaacgtacatgggaatgtatgaatgtgggggttttgtgactggataactgacggtcagtggacgccgttgttcaaatatccaagagatgcgagaaactttgggtcaagtgaacatgtcctctctgttcaagtaaaccatcaactatgggtagtatatttagtaaggacaagagttgagattctttggagtcctagaaacgtattttcgcgttccaagatcaaattagtagagtaatacgggcacgggaatccattcatagtctcaatcctgcaggtgagttaattaatcgagcttggcgtaatcatggtcatagctgtttcctgtgtgaaattgttatccgctcacaattccacacaacgtacgatagttagtagacaacaatcagaacatctccctccttatataatcacacaggccagaacgcgctaaactaaagcgctttggacactatgttacattggcattgattgaactgaaaccacagtctccctcgcctgaatcgagcaatggatgttgtcggaagtcaacttcactagaagagcggttctatgccttgtcaagatcatatcataaactcactctgtattaccccatctatagaacacttgttatgaatgggcggaaacattccgctatatgcacctttccacactaatgcaaagatgtgcatcttcaacgggtagtaagactggttccgacttccgttgcatggagagcaatgacctcgataatgcgaacatcccccacatatacactcttacacaggccaatataatctgtgcatttactaaatatttaagtctatgcacctgcttgatgaaaagcggcacggatggtatcatctagtttccgccaatccaagaaccaactgtgttggcagtggtgtagcccatggcacacagaccaaagatgaaaatacagacatcggcggttcgagccgtggtgcctcgagcaacacccttgtaatgcaaaagaggagggtaaatgtacaccagaggcacacatgcaaacgatccggtgagagcgacgaaccgatcgagatcgtcggcacctccccatgcaacaaaggcggtgacaaacacaaggaagaaccggaaaatgttcttctgccacttgatggtagagttgtacttgcctgatcgggtgaagagaccattctcgatgattcggatggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcttagaagtgaggattacaagaagcctctggatatcaatgatgaacgtactcagcggctggtcaagcatttcgaccgtcgaatcgacgaggtgttcacctttgacaagcgagggttcccaattgatcacgttctcgagttgttcaaatcttctctcaacatctctctgcatgaactatctctgttgacgaacgtgtcacccactgttcctcgaacgcccttctccgagtttggtctgaacatcttcgatctcaaactgacccccgcagtgatcaatagtgccatgccactgccgatgcggtgcgaacatccctggagggattctcggagctctacacaatgcagattctgtcgtcgagtactctctaccttgctcgaatgacttattgtgctactactgcactcatgcttcgatcatgtgccctactgcaccccaaatttggtgatctgattgagacagagtaccctcttcagctgattcagaagatcatcagcaacatgaatgatgtggttgaccaggcaggctgttgtagtcacgtccttcacttcaagttcattcttcatctgcttctgttttactttgacaggcaaatgaagacatggtacgacttgatggaggccaagaacgccatttcaccccgagacaccgaagtgcctgaaatcctggctgcccccattgataacatcggaaactacggtattccggaaagtgtatatagaacctttccccagcttgtgtctgtggatatggatggtgtaatccccttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggcaacgggcttgatgacagcgggaggagtgcccacattgtttcggtttcgaaagaacaggacacccttgccagctccctcggcaccagcggagggttcaacccactggcacattcgtgcagatcggtacatggctcgaatgaatcctcgaggaccgtcctggacatcagctcgatagtgcttgcccatgataggtttgatggcctcggtagcttcgtccgcattgtagaagggaatggaagagacgtagtgatgcaggacgtgagtctcgataatgccgtggagcagatgacgtccaatgaagcccatctctcggtcgatggttgcagcggcacctcgcacaaagttccactcgtcgttggtgtagtggggaagagtaggatctgtgtgctgcagaaaggtaatggcgacgagccagtggttaacccacaagtagggaacgaagtaccagatggccatgttgtagaatccgaacttctgaacgagaaagtacagagcggtggccataagaccaatgccaatgtcggagagcacgatgagcttggcgtcgctgttctcgtacagaggagatcggggatcgaaatggttaactccaccgccaagaccgttgtgctttcccttgcctcgaccctctcgctgccgctcatggtagttgtgtccagtaacgttggtaatgagatagttgggccaaccgaccagttgctgaagcacaagcatgagcagggtgaaagcaggagtttcctcggtaagatgggcgagttcgtgggtcatcttgccgagtcgagtagcttgctgctctcgggttcgaggaacgaagaccatgtctcgctccatgtttccagtggccttgtgatgcttccggtgggagatttgccagctgaagtagggaacaagcagggaagagtgaagcacccagccagtaatgtcgttgatgattcgggaatcggagaaagcaccatgtccacactcgtgggcaatgacccacagtccagtaccgaagagtccctgaagaacggtgtacacagcccacagaccggctcgagcaggagtggagggaatgtactcgggtgtcacaaagttgtaccagatgctgaaagtggtagtcaggaggacaatgtctcgaagaatgtagccgtatcccttgagagcagatcgcttgaagcagtgcttgggaatagcgttgtagatgtccttgatggtgaagtcgggaacttcgaactggttgccgtaggtatccagcatgacaccgtactcggacttgggcttggcaatgtccacctcggacatggaagacagcgatgtagaggaggccgagtgtctgggagaatcggagggagagacggcagcagactccgagtcggtcacagtggtggaagtgacggttcgtcggagggcagggttctgcttgggcagagccgaggtggaggccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattcctttacctgcaggataacttcgtataatgtatgctatacgaagttatgatctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgcgataacttcgtataatgtatgctatacgaagttatcgtacgatagttagtagacaacaatcgatcgaggaagaggacaagcggctgcttcttaagtttgtgacatcagtatccaaggcaccattgcaaggattcaaggctttgaacccgtcatttgccattcgtaacgctggtagacaggttgatcggttccctacggcctccacctgtgtcaatcttctcaagctgcctgactatcaggacattgatcaacttcggaagaaacttttgtatgccattcgatcacatgctggtttcgatttgtcttagaggaacgcatatacagtaatcatagagaataaacgatattcatttattaaagtagatagttgaggtagaagttgtaaagagtgataaatagcggccgctcactgaatctttttggctcccttgtgctttcggacgatgtaggtctgcacgtagaagttgaggaacagacacaggacagtaccaacgtagaagtagttgaaaaaccagccaaacattctcattccatcttgtcggtagcagggaatgttccggtacttccagacgatgtagaagccaacgttgaactgaatgatctgcatagaagtaatcagggacttgggcatagggaacttgagcttgatcagtcgggtccaatagtagccgtacatgatccagtgaatgaagccgttgagcagcacaaagatccaaacggcttcgtttcggtagttgtagaacagccacatgtccataggagctccgagatggtgaaagaactgcaaccaggtcagaggcttgcccatgaggggcagatagaaggagtcaatgtactcgaggaacttgctgaggtagaacagctgagtggtgattcggaagacattgttgtcgaaagccttctcgcagttgtcggacatgacaccaatggtgtacatggcgtaggccatagagaggaaggagcccagcgagtagatggacatgagcaggttgtagttggtgaacacaaacttcattcgagactgacccttgggtccgagaggaccaagggtgaacttcaggatgacgaaggcgatggagaggtacagcacctcgcagtgcgaggcatcagaccagagctgagcatagtcgaccttgggaagaacctcctggccaatggagacgatttcgttcacgacctccatggttgtgaattagggtggtgagaatggttggttgtagggaagaatcaaaggccggtctcgggatccgtgggtatatatatatatatatatatatacgatccttcgttacctccctgttctcaaaactgtggtttttcgtttttcgttttttgctttttttgatttttttagggccaactaagcttccagatttcgctaatcacctttgtactaattacaagaaaggaagaagctgattagagttgggctttttatgcaactgtgctactccttatctctgatatgaaagtgtagacccaatcacatcatgtcatttagagttggtaatactgggaggatagataaggcacgaaaacgagccatagcagacatgctgggtgtagccaagcagaagaaagtagatgggagccaattgacgagcgagggagctacgccaatccgacatacgacacgctgagatcgtcttggccggggggtacctacagatgtccaagggtaagtgcttgactgtaattgtatgtctgaggacaaatatgtagtcagccgtataaagtcataccaggcaccagtgccatcatcgaaccactaactctctatgatacatgcctccggtattattgtaccatgcgtcgctttgttacatacgtatcttgcctttttctctcagaaactccagactttggctattggtcgagataagcccggaccatagtgagtctttcacactctgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaattt

SEQ ID NO: 133 - DNA, 4313 bp, Artificial Sequence
  Plasmid pZKUM
taatcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgacgagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgacttaat

SEQ ID NO: 134 - DNA, 1459 bp, Artificial Sequence
  Synthetic mutant Ura3 gene, comprising a 33 bp deletion from +21 to +53, a  1 bp deletion at +376 and a 3 bp deletion from +400 to 403 of the Yarrowia Ura3 coding region (GenBank Accession No. AJ306421)
gagtatctgtctgactcgtcattgccgcctttggagtacgactccaactatgagtgtgcttggatcactttgacgatacattcttcgttggaggctgtgggtctgacagctgcgttttcggcgcggttggccgacaacaatatcagctgcaacgtcattgctggctttcatcatgatcacatttttgtcggcaaaggcgacgcccagagagccattgacgttctttctaatttggaccgatagccgtatagtccagtctatctataagttcaactaactcgtaactattaccataacatatacttcactgccccagataaggttccgataaaaagttctgcagactaaatttatttcagtctcctcttcaccaccaaaatgccctcctacgaagctcgagtgctcaagctcgtggcagccaagaaaaccaacctgtgtgcttctctggatgttaccaccaccaaggagctcattgagcttgccgataaggtcggaccttatgtgtgcatgatcaaaacccatatcgacatcattgacgacttcacctacgccggcactgtgctccccctcaaggaacttgctcttaagcacggtttcttcctgttcgaggacagaaagttcgcagatattggcaacactgtcaagcaccagtaccggtgtcaccgaatcgccgagtggtccgatatcaccaacgcccacggtgtacccggaaccggaatcgattgctggcctgcgagctggtgcgtacgaggaaactgtctctgaacagaagaaggaggacgtctctgactacgagaactcccagtacaaggagttcctagtcccctctcccaacgagaagctggccagaggtctgctcatgctggccgagctgtcttgcaagggctctctggccactggcgagtactccaagcagaccattgagcttgcccgatccgaccccgagtttgtggttggcttcattgcccagaaccgacctaagggcgactctgaggactggcttattctgacccccggggtgggtcttgacgacaagggagacgctctcggacagcagtaccgaactgttgaggatgtcatgtctaccggaacggatatcataattgtcggccgaggtctgtacggccagaaccgagatcctattgaggaggccaagcgataccagaaggctggctgggaggcttaccagaagattaactgttagaggttagactatggatatgtaatttaactgtgtatatagagagcgtgcaagtatggagcgcttgttcagcttgtatgatggtcagacgacctgtctgatcgagtatgtatgatactgcacaacctgtgtatccgcatgatctgtccaatggggcatgttgttgtgtttctcgatacggagatgctgggtacagtgctaatacgttgaactacttatacttatatgaggctcgaagaaagctgacttgtgtatgac

SEQ ID NO: 135 - DNA, 15966 bp, Artificial Sequence
  Plasmid pZKD2-5U89A2
gtacgtttcatgaaggcgggcagaaagtactcgatggtggagatgattgctcggaggtacttgttctgcggccagtatctctcagcaatcaggtgatactcctggacgtccagagggtagtatgtgtgcgtgggctccagatccaccgtcttgtgcagagttatggggaagtagcggccaaagagcttccagatgaagaagtttcttgaaataggcgagtatcgcttgaccactcctccgttggacggggagtcgtctttaacagcgtacactacatacgcaatcacaaatggccagagcagtggaattgcgcagcatagcatgaaaattgtgaggaaagtgggaatgctgaaaatgtgccagaccagagagaaggtctcacatcggttgagtaatggtgtcgatagcggggcatatcggattcccgcgattttgggtgccgtgtcgtttttgtctcgcgacttgtagtattgtgagtcgatagtcatagcttttgttttgtgtgacttgtctgttgcctgttgttagaagaaaaagtgggagcttatcagtcacggtccacgaacgatttcgtacttgtacgtaattggtcgtgagaactgttgcagagccggtgcttttttttgtggccaagtcgacaggtcgatttcggcgctgtgcgaggttgctgggatgtgctggtttggctgccaaatgtggggaagatttcaacctcggatttgacgtgtgtagaggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcatcaaaggaagggtgaatccaaggaagttcttgacaaactgctggaatcggtacagcttggacgacttgtcgttgctaacctggtcatagaggtcgttctcaccaaaggccatgatgggaacaagggcgacatttccgacctccataccaagtcgaacaaaaccctttcgcttgagtagcaccaggtccatgacaccgggtctggccagaagactttcctgtgctccaccaacgacaatgcagatagactggtttcgcttgaggagggccttgcaggacttcttggagacagaagcgactcccagactcatgaggtactctctgtagagaggcactcggaagttgttggtgagagtcataagagaaacagggatgcccggaaagagcttggaccatccagctccctcggtggcaattccaccaaaggctcccatgccgataatgccgtgggggtggtagccgaagatgtattttctgccagtgggcttgagttttgtgggcgacagctgtgggtcgttttcgccaatgatctggttggcgtaggagttgagggacccgttaagaagcgtggaatcagatgcagtggagccagcagaggcggacgacaaaggtcgtcggttagtggtgccattgttgccgttgccgttaagttcggagcccgaggcgtggccgttggagccagatgattctccacggctatatctgctgtcgtggttaattaactcacctgcaggattgagactatgaatggattcccgtgcccgtattactctactaatttgatcttggaacgcgaaaatacgtttctaggactccaaagaatctcaactcttgtccttactaaatatactacccatagttgatggtttacttgaacagagaggacatgttcacttgacccaaagtttctcgcatctcttggatatttgaacaacggcgtccactgaccgtcagttatccagtcacaaaacccccacattcatacattcccatgtacgtttacaaagttctcaattccatcgtgcaaatcaaaatcacatctattcattcatcatatataaacccatcatgtctactaacactcacaactccatagaaaacatcgactcagaacacacgctccatgcggccgcttaggaatcctgagcgtccttgacacagtgaaccacaccgactttgtgcatgtacttgagggtggaaatgatgttgcccacaatggtagggtagaagacgtaccgaactccgtgtcgttcgcaacactctcggacagcttgctgcacgaagggatagtgccaagacgacattcgaggaaagaggtgatgctcgatctggaagttgagaccgccagtaaagaacatggcaatgggtccaccgtaggtggaagaggtctccacctgagctctgtaccagtcgatctgatcggcttcaacgtccttctcggagctcttgaccttgcagttcttgtcggggattcgctccgagccatcgaagttgtgagacaagatgaaaaagaaggtgaggaaggcaccggtagcagtgggcaccagaggaatggtgatgagcagggaggttccagtgagataccagggcaagaaggcggttcgaaagatgaagaaagctcgcataacgaatgcaagggttcggtaccgtcgcagaaagccgttctctcgcatggctgtgacagactcgggaatggtgtcgttgtgctgcattcggaagatgtagagagggttgtacaccagcgaaacgccgtaggctccaagcacgaggtacatgtaccaggcctggaatcggtgaaaccactttcgagcagtgttggcagcagggtagttgtggaacacaaggaatggttctgcggactcggcatccaggtcgagaccatgctgattggtgtaggtgtgatgtcgcatgatgtgagactgcagccagatccatctggacgatccaatgacgtcgatgccgtaggcaaagagagcgttgacccagggctttttgctgatggcaccatgagaggcatcgtgctgaatggacaggccgatctgcatgtgcatgaatccagtcaagagaccccacagcaccattccggtagtagcccagtgccactcgcaaaaggcggtgacagcaatgatgccaacggttcgcagccagaatccaggtgtggcataccagttccgacctttcatgacctctcgcatagttcgcttgacgtcctgtgcaaagggagagtcgtaggtgtagacaatgtccttggaggttcggtcgtgcttgcctcgcacgaactgttgaagcagcttcgagttctcgggcttgacgtaagggtgcatggagtagaacagaggagaagcatcggaggcaccagaagcgaggatcaagtcgcctccgggatggaccttggcaagaccttccagatcgtagagaatgccgtcgatggcaaccaggtcgggtcgctcgagcagctgctcggtagtaagggagagagccatggccattgctgtagatatgtcttgtgtgtaagggggttggggtggttgtttgtgttcttgacttttgtgttagcaagggaagacgggcaaaaaagtgagtgtggttgggagggagagacgagccttatatataatgcttgtttgtgtttgtgcaagtggacgccgaaacgggcaggagccaaactaaacaaggcagacaatgcgagcttaattggattgcctgatgggcaggggttagggctcgatcaatgggggtgcgaagtgacaaaattgggaattaggttcgcaagcaaggctgacaagactttggcccaaacatttgtacgcggtggacaacaggagccacccatcgtctgtcacgggctagccggtcgtgcgtcctgtcaggctccacctaggctccatgccactccatacaatcccactagtgtaccgctaggccgcttttagctcccatctaagacccccccaaaacctccactgtacagtgcactgtactgtgtggcgatcaagggcaagggaaaaaaggcgcaaacatgcacgcatggaatgacgtaggtaaggcgttactagactgaaaagtggcacatttcggcgtgccaaagggtcctaggtgcgtttcgcgagctgggcgccaggccaagccgctccaaaacgcctctccgactccctccagcggcctccatatccccatccctctccacagcaatgttgttaagccttgcaaacgaaaaaatagaaaggctaataagcttccaatattgtggtgtacgctgcataacgcaacaatgagcgccaaacaacacacacacacagcacacagcagcattaaccacgatgaacagcatgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggctgccgtcatcgaggtggccaacgagttcgtcgctatcactgccgagacccttcccaaggtggactatcagcgactctggcgagacatctactcctgcgagctcctgtacttctccattgctttcgtcatcctcaagtttacccttggcgagctctcggattctggcaaaaagattctgcgagtgctgttcaagtggtacaacctcttcatgtccgtcttttcgctggtgtccttcctctgtatgggttacgccatctacaccgttggactgtactccaacgaatgcgacagagctttcgacaacagcttgttccgatttgccaccaaggtcttctactattccaagtttctggagtacatcgactctttctaccttcccctcatggccaagcctctgtcctttctgcagttctttcatcacttgggagctcctatggacatgtggctcttcgtgcagtactctggcgaatccatttggatctttgtgttcctgaacggattcattcactttgtcatgtacggctactattggacacggctgatgaagttcaactttcccatgcccaagcagctcattaccgcaatgcagatcacccagttcaacgttggcttctacctcgtgtggtggtacaaggacattccctgttaccgaaaggatcccatgcgaatgctggcctggatcttcaactactggtacgtcggtaccgttcttctgctcttcatcaacttctttgtcaagtcctacgtgtttcccaagcctaagactgccgacaaaaaggtccagtagcggccgcatgtacatacaagattatttatagaaatgaatcgcgatcgaacaaagagtacgagtgtacgagtaggggatgatgataaaagtggaagaagttccgcatctttggatttatcaacgtgtaggacgatacttcctgtaaaaatgcaatgtctttaccataggttctgctgtagatgttattaactaccattaacatgtctacttgtacagttgcagaccagttggagtatagaatggtacacttaccaaaaagtgttgatggttgtaactacgatatataaaactgttgacgggatctgtatattcggtaagatatattttgtggggttttagtggtgtttaaacaccactaaaaccccacaaaatatatcttaccgaatatacagatctactatagaggaacaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacacaatgcctgttactgacgtccttaagcgaaagtccggtgtcatcgtcggcgacgatgtccgagccgtgagtatccacgacaagatcagtgtcgagacgacgcgttttgtgtaatgacacaatccgaaagtcgctagcaacacacactctctacacaaactaacccagctctccatggtgaaggcttctcgacaggctctgcccctcgtcatcgacggaaaggtgtacgacgtctccgcttgggtgaacttccaccctggtggagctgaaatcattgagaactaccagggacgagatgctactgacgccttcatggttatgcactctcaggaagccttcgacaagctcaagcgaatgcccaagatcaaccaggcttccgagctgcctccccaggctgccgtcaacgaagctcaggaggatttccgaaagctccgagaagagctgatcgccactggcatgtttgacgcctctcccctctggtactcgtacaagatcttgaccaccctgggtcttggcgtgcttgccttcttcatgctggtccagtaccacctgtacttcattggtgctctcgtgctcggtatgcactaccagcaaatgggatggctgtctcatgacatctgccaccaccagaccttcaagaaccgaaactggaataacgtcctgggtctggtctttggcaacggactccagggcttctccgtgacctggtggaaggacagacacaacgcccatcattctgctaccaacgttcagggtcacgatcccgacattgataacctgcctctgctcgcctggtccgaggacgatgtcactcgagcttctcccatctcccgaaagctcattcagttccaacagtactatttcctggtcatctgtattctcctgcgattcatctggtgtttccagtctgtgctgaccgttcgatccctcaaggaccgagacaaccagttctaccgatctcagtacaagaaagaggccattggactcgctctgcactggactctcaagaccctgttccacctcttctttatgccctccatcctgacctcgatgctggtgttctttgtttccgagctcgtcggtggcttcggaattgccatcgtggtcttcatgaaccactaccctctggagaagatcggtgattccgtctgggacggacatggcttctctgtgggtcagatccatgagaccatgaacattcgacgaggcatcattactgactggttctttggaggcctgaactaccagatcgagcaccatctctggcccaccctgcctcgacacaacctcactgccgtttcctaccaggtggaacagctgtgccagaagcacaacctcccctaccgaaaccctctgccccatgaaggtctcgtcatcctgctccgatacctgtcccagttcgctcgaatggccgagaagcagcccggtgccaaggctcagtaagcggccgcatgagaagataaatatataaatacattgagatattaaatgcgctagattagagagcctcatactgctcggagagaagccaagacgagtactcaaaggggattacaccatccatatccacagacacaagctggggaaaggttctatatacactttccggaataccgtagtttccgatgttatcaatgggggcagccaggatttcaggcacttcggtgtctcggggtgaaatggcgttcttggcctccatcaagtcgtaccatgtcttcatttgcctgtcaaagtaaaacagaagcagatgaagaatgaacttgaagtgaaggaatttaaatagttggagcaagggagaaatgtagagtgtgaaagactcactatggtccgggcttatctcgaccaatagccaaagtctggagtttctgagagaaaaaggcaagatacgtatgtaacaaagcgacgcatggtacaataataccggaggcatgtatcatagagagttagtggttcgatgatggcactggtgcctggtatgactttatacggctgactacatatttgtcctcagacatacaattacagtcaagcacttacccttggacatctgtaggtaccccccggccaagacgatctcagcgtgtcgtatgtcggattggcgtagctccctcgctcgtcaattggctcccatctactttcttctgcttggctacacccagcatgtctgctatggctcgttttcgtgccttatctatcctcccagtattaccaactctaaatgacatgatgtgattgggtctacactttcatatcagagataaggagtagcacagttgcataaaaagcccaactctaatcagcttcttcctttcttgtaattagtacaaaggtgattagcgaaatctggaagcttagttggccctaaaaaaatcaaaaaaagcaaaaaacgaaaaacgaaaaaccacagttttgagaacagggaggtaacgaaggatcgtatatatatatatatatatatatacccacggatcccgagaccggcctttgattcttccctacaaccaaccattctcaccaccctaattcacaaccatggcctccacctcggctctgcccaagcagaaccctgccctccgacgaaccgtcacttccaccactgtgaccgactcggagtctgctgccgtctctccctccgattctcccagacactcggcctcctctacatcgctgtcttccatgtccgaggtggacattgccaagcccaagtccgagtacggtgtcatgctggatacctacggcaaccagttcgaagttcccgacttcaccatcaaggacatctacaacgctattcccaagcactgcttcaagcgatctgctctcaagggatacggctacattcttcgagacattgtcctcctgactaccactttcagcatctggtacaactttgtgacacccgagtacattccctccactcctgctcgagccggtctgtgggctgtgtacaccgttcttcagggactcttcggtactggactgtgggtcattgcccacgagtgtggacatggtgctttctccgattcccgaatcatcaacgacattactggctgggtgcttcactcttccctgcttgttccctacttcagctggcaaatctcccaccggaagcatcacaaggccactggaaacatggagcgagacatggtcttcgttcctcgaacccgagagcagcaagctactcgactcggcaagatgacccacgaactcgcccatcttaccgaggaaactcctgctttcaccctgctcatgcttgtgcttcagcaactggtcggttggcccaactatctcattaccaacgttactggacacaactaccatgagcggcagcgagagggtcgaggcaagggaaagcacaacggtcttggcggtggagttaaccatttcgatccccgatctcctctgtacgagaacagcgacgccaagctcatcgtgctctccgacattggcattggtcttatggccaccgctctgtactttctcgttcagaagttcggattctacaacatggccatctggtacttcgttccctacttgtgggttaaccactggctcgtcgccattacctttctgcagcacacagatcctactcttccccactacaccaacgacgagtggaactttgtgcgaggtgccgctgcaaccatcgaccgagagatgggcttcattggacgtcatctgctccacggcattatcgagactcacgtcctgcatcactacgtctcttccattcccttctacaatgcggacgaagctaccgaggccatcaaacctatcatgggcaagcactatcgagctgatgtccaggacggtcctcgaggattcattcgagccatgtaccgatctgcacgaatgtgccagtgggttgaaccctccgctggtgccgagggagctggcaagggtgtcctgttctttcgaaaccgaaacaatgtgggcactcctcccgctgtcatcaagcccgttgcctaagcggccgctatttatcactctttacaacttctacctcaactatctactttaataaatgaatatcgtttattctctatgattactgtatatgcgttcctctaagacaaatcgaaaccagcatgtgatcgaatggcatacaaaagtttcttccgaagttgatcaatgtcctgatagtcaggcagcttgagaagattgacacaggtggaggccgtagggaaccgatcaacctgtctaccagcgttacgaatggcaaatgacgggttcaaagccttgaatccttgcaatggtgccttggatactgatgtcacaaacttaagaagcagccgcttgtcctcttcctcgatcgatggtcatagctgtttcctgtgtgaaattgttatccgctcacaattccacacaac

SEQ ID NO: 136 - DNA, 21 bp, Artificial Sequence
  Primer pZP-GW-5-1
cgacaagatggaatgagaatg

SEQ ID NO: 137 - DNA, 22 bp, Artificial Sequence
  Primer pZP-GW-5-2
ctggtttttcaactacttctac

SEQ ID NO: 138 - DNA, 21 bp, Artificial Sequence
  Primer pZP-GW-5-3
gtactgtcctgtgtctgttcc

SEQ ID NO: 139 - DNA, 22 bp, Artificial Sequence
  Primer pZP-GW-5-4
ctacatcgtccgaaagcacaag

SEQ ID NO: 140 - DNA, 24 bp, Artificial Sequence
  Primer pZP-GW-3-1
ctaccagatcgagcaccatctctg

SEQ ID NO: 141 - DNA, 21 bp, Artificial Sequence
  Primer pZP-GW-3-2
ctaccaggtggaacagctgtg

SEQ ID NO: 142 - DNA, 22 bp, Artificial Sequence
  Primer pZP-GW-3-3
tctgccccatgaaggtctcgtc

SEQ ID NO: 143 - DNA, 22 bp, Artificial Sequence
  Primer pZP-GW-3-4
cctgtcccagttcgctcgaatg

SEQ ID NO: 144 - DNA, 44 bp, Artificial Sequence
  Genome Walker adaptor-1
gtaatacgactatagggcacgcgtggtcgacggcccgggctggt

SEQ ID NO: 145 - DNA, 8 bp, Artificial Sequence
  Genome Walker adaptor-2
  misc_feature (1)..(1): 5' end is associated with a -PO4 group
  misc_feature (8)..(8): 3' end is associated with a -H2N group
accagccc

SEQ ID NO: 146 - DNA, 22 bp, Artificial Sequence
  Nested adaptor primer
gtaatacgactcactatagggc

SEQ ID NO: 147 - DNA, 36 bp, Artificial Sequence
  Primer Per10F1
gatcaaccatggggggaagttcacatgcattcgctg

SEQ ID NO: 148 - DNA, 29 bp, Artificial Sequence
  Primer ZPGW-5-5
gttatagttttcatgtgaaataccgagag

SEQ ID NO: 149 - DNA, 37 bp, Artificial Sequence
  Primer Per10R
gatcaagcggccgccagacctcgtcattatctgatag

SEQ ID NO: 150 - DNA, 7222 bp, Artificial Sequence
  Plasmid pFBAIn-MOD-1
catggatccaggcctgttaacggccattacggcctgcaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtac

SEQ ID NO: 151 - DNA, 8133 bp, Artificial Sequence
  Plasmid pFBAIN-Pex10
ggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaaaacagtgtacgcagatctactatagaggaacatttaaattgccccggagaagacggccaggccgcctagatgacaaattcaacaactcacagctgactttctgccattgccactaggggggggcctttttatatggccaagccaagctctccacgtcggttgggctgcacccaacaataaatgggtagggttgcaccaacaaagggatgggatggggggtagaagatacgaggataacggggctcaatggcacaaataagaacgaatactgccattaagactcgtgatccagcgactgacaccattgcatcatctaagggcctcaaaactacctcggaactgctgcgctgatctggacaccacagaggttccgagcactttaggttgcaccaaatgtcccaccaggtgcaggcagaaaacgctggaacagcgtgtacagtttgtcttaacaaaaagtgagggcgctgaggtcgagcagggtggtgtgacttgttatagcctttagagctgcgaaagcgcgtatggatttggctcatcaggccagattgagggtctgtggacacatgtcatgttagtgtacttcaatcgccccctggatatagccccgacaataggccgtggcctcatttttttgccttccgcacatttccattgctcggtacccacaccttgcttctcctgcacttgccaaccttaatactggtttacattgaccaacatcttacaagcggggggcttgtctagggtatatataaacagtggctctcccaatcggttgccagtctcttttttcctttctttccccacagattcgaaatctaaactacacatcacagaattccgagccgtgagtatccacgacaagatcagtgtcgagacgacgcgttttgtgtaatgacacaatccgaaagtcgctagcaacacacactctctacacaaactaacccagctctggtaccatggggggaagttcacatgcattcgctggtgaatctgatctgacactacaactacacaccaggtccaacatgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataatgacgaggtctggc

SEQ ID NO: 152 - DNA, 35 bp, Artificial Sequence
  Primer PEX10-R-BsiWI
gatcaacgtacgcttcagcagtaactgtattgctc

SEQ ID NO: 153 - DNA, 35 bp, Artificial Sequence
  Primer PEX10-F1-SalI
gatcaagtcgacattgtaactagtcctggagggtc

SEQ ID NO: 154 - DNA, 36 bp, Artificial Sequence
  Primer PEX10-F2-SalI
gatcaagtcgacgtcttagcgtcatgtattctcaag

SEQ ID NO: 155 - DNA, 7277 bp, Artificial Sequence
  Plasmid pEXP-MOD1
catggatccaggcctgttaacggccattacggcctgcaggatccgaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgcggccgcaagtgtggatggggaagtgagtgcccggttctgtgtgcacaattggcaatccaagatggatggattcaacacagggatatagcgagctacgtggtggtgcgaggatatagcaacggatatttatgtttgacacttgagaatgtacgatacaagcactgtccaagtacaatactaaacatactgtacatactcatactcgtacccgggcaacggtttcacttgagtgcagtggctagtgctcttactcgtacagtgtgcaatactgcgtatcatagtctttgatgtatatcgtattcattcatgttagttgcgtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccgtacggggagtttggcgcccgttttttcgagccccacacgtttcggtgagtatgagcggcggcagattcgagcgtttccggtttccgcggctggacgagagcccatgatgggggctcccaccaccagcaatcagggccctgattacacacccacctgtaatgtcatgctgttcatcgatggttaatgctgctgtgtgctgtgtgtgtgtgttgtttggcgctcattgttgcgttatgcagcgtacaccacaatattggaagcttattagcctttctattttttcgtttgcaaggcttaacaacattgctgtggagagggatggggatatggaggccgctggagggagtcggagaggcgttttggagcggcttggcctggcgcccagctcgcgaaacgcacctaggaccctttggcacgccgaaatgtgccacttttcagtctagtaacgccttacctacgtcattccatgcgtgcatgtttgcgccttttttcccttgcccttgatcgccacacagtacagtgcactgtacagtggaggttttgggggggtcttagatgggagctaaaagcggcctagcggtacactagtgggattgtatggagtggcatggagcctaggtggagcctgacaggacgcacgaccggctagcccgtgacagacgatgggtggctcctgttgtccaccgcgtacaaatgtttgggccaaagtcttgtcagccttgcttgcgaacctaattcccaattttgtcacttcgcacccccattgatcgagccctaacccctgcccatcaggcaatccaattaagctcgcattgtctgccttgtttagtttggctcctgcccgtttcggcgtccacttgcacaaacacaaacaagcattatatataaggctcgtctctccctcccaaccacactcacttttttgcccgtcttcccttgctaacacaaaagtcaagaacacaaacaaccaccccaacccccttacacacaagacatatctacagcaatggc

SEQ ID NO: 156 - DNA, 7559 bp, Artificial Sequence
  Plasmid pPEX10-1
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacattgtaactagtcctggagggtcttttttatggataacctccatgtacgatgtatccaagatctccacgtactgtgttctgtttcctaagtaatacccaacaacctctccaacaaacacttgggaagatgcacttgtgctgagatgtcaagatgttagtactgtactggatggagagaatattaataaataattgttacccaactacatcttgtcgattgaaagagatacccctaagacagataggatatctgcaacccgaggaatgaaccccccagcaccggcaccctttctattaacaaaatgccaactgaaatttgaaaagttcaactaaacttatttgacccacaaaaactcgtcaaaagtggcggcgaaagctggcaaatgatgacatccccttggaactatgatatcccctcggaatcttcgtccccatttgccacatctacttgcaacgccacgtctgcttactaagcaacccaaatctgcctcggctcaaaatgtggggaagttcacatgcattcgctggtgaatctgatctgacactacaactacacaccaggtccaacatgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataatgacgaggtctggatggaaggactagtcagcgagacacagagcatcagggaccagacacgaccaattcaatcgacaacactgtgctgcatagcagtgcacagaggtcctgggcatgaatatattttagcattggagatatgagtggtagagcgtatacagtattaattgtggaggtatctcgtcgcattgatagagcaatacagttactgctgaagc

SEQ ID NO: 157 - DNA, 8051 bp, Artificial Sequence
  Plasmid pPEX10-2
gtacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggtaccgggccccccctcgaggtcgatggtgtcgataagcttgatatcgaattcatgtcacacaaaccgatcttcgcctcaaggaaacctaattctacatccgagagactgccgagatccagtctacactgattaattttcgggccaataatttaaaaaaatcgtgttatataatattatatgtattatatatatacatcatgatgatactgacagtcatgtcccattgctaaatagacagactccatctgccgcctccaactgatgttctcaatatttaaggggtcatctcgcattgtttaataataaacagactccatctaccgcctccaaatgatgttctcaaaatatattgtatgaacttatttttattacttagtattattagacaacttacttgctttatgaaaaacacttcctatttaggaaacaatttataatggcagttcgttcatttaacaatttatgtagaataaatgttataaatgcgtatgggaaatcttaaatatggatagcataaatgatatctgcattgcctaattcgaaatcaacagcaacgaaaaaaatcccttgtacaacataaatagtcatcgagaaatatcaactatcaaagaacagctattcacacgttactattgagattattattggacgagaatcacacactcaactgtctttctctcttctagaaatacaggtacaagtatgtactattctcattgttcatacttctagtcatttcatcccacatattccttggatttctctccaatgaatgacattctatcttgcaaattcaacaattataataagatataccaaagtagcggtatagtggcaatcaaaaagcttctctggtgtgcttctcgtatttatttttattctaatgatccattaaaggtatatatttatttcttgttatataatccttttgtttattacatgggctggatacataaaggtattttgatttaattttttgcttaaattcaatcccccctcgttcagtgtcaactgtaatggtaggaaattaccatacttttgaagaagcaaaaaaaatgaaagaaaaaaaaaatcgtatttccaggttagacgttccgcagaatctagaatgcggtatgcggtacattgttcttcgaacgtaaaagttgcgctccctgagatattgtacatttttgcttttacaagtacaagtacatcgtacaactatgtactactgttgatgcatccacaacagtttgttttgtttttttttgttttttttttttctaatgattcattaccgctatgtatacctacttgtacttgtagtaagccgggttattggcgttcaattaatcatagacttatgaatctgcacggtgtgcgctgcgagttacttttagcttatgcatgctacttgggtgtaatattgggatctgttcggaaatcaacggatgctcaatcgatttcgacagtaattaattaagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgacgtcttagcgtcatgtattctcaagcttagtcagagagaaggactatggaggagaaggggagaattgagaagggtatttgaagggactttgaaggtcgcgtggaagaggtacttgaagaggtatttgaaggtcacgtggaagaggtatttgaagatcacgtggaagaagtacttgttttacagagaatatcggggtgattttgacagtgggattgtctcccaagtcctaatcgtttgacatgggagcagtgaaaagtcgggctaaaaaagggaatatcggaaatcggaaagacggaaagaattactggactcatgtttagtagatctgagcacttcaaatttgaaaatatctcttcaaacagcagatcggttggtcgtggaggtaccatcaagggtaaaatcaaggctatcatcaagggccatatatcgcaagtttgggggaagataatatgttcatagtgaatcagggttgtggatttcctcatctaacggcattgtaactagtcctggagggtcttttttatggataacctccatgtacgatgtatccaagatctccacgtactgtgttctgtttcctaagtaatacccaacaacctctccaacaaacacttgggaagatgcacttgtgctgagatgtcaagatgttagtactgtactggatggagagaatattaataaataattgttacccaactacatcttgtcgattgaaagagatacccctaagacagataggatatctgcaacccgaggaatgaaccccccagcaccggcaccctttctattaacaaaatgccaactgaaatttgaaaagttcaactaaacttatttgacccacaaaaactcgtcaaaagtggcggcgaaagctggcaaatgatgacatccccttggaactatgatatcccctcggaatcttcgtccccatttgccacatctacttgcaacgccacgtctgcttactaagcaacccaaatctgcctcggctcaaaatgtggggaagttcacatgcattcgctggtgaatctgatctgacactacaactacacaccaggtccaacatgagcgacaatacgacaatcaaaaagccgatccgacccaaaccgatccggacggaacgcctgccttacgctggggccgcagaaatcatccgagccaaccagaaagaccactactttgagtccgtgcttgaacagcatctcgtcacgtttctgcagaaatggaagggagtacgatttatccaccagtacaaggaggagctggagacggcgtccaagtttgcatatctcggtttgtgtacgcttgtgggctccaagactctcggagaagagtacaccaatctcatgtacactatcagagaccgaacagctctaccgggggtggtgagacggtttggctacgtgctttccaacactctgtttccatacctgtttgtgcgctacatgggcaagttgcgcgccaaactgatgcgcgagtatccccatctggtggagtacgacgaagatgagcctgtgcccagcccggaaacatggaaggagcgggtcatcaagacgtttgtgaacaagtttgacaagttcacggcgctggaggggtttaccgcgatccacttggcgattttctacgtctacggctcgtactaccagctcagtaagcggatctggggcatgcgttatgtatttggacaccgactggacaagaatgagcctcgaatcggttacgagatgctcggtctgctgattttcgcccggtttgccacgtcatttgtgcagacgggaagagagtacctcggagcgctgctggaaaagagcgtggagaaagaggcaggggagaaggaagatgaaaaggaagcggttgtgccgaaaaagaagtcgtcaattccgttcattgaggatacagaaggggagacggaagacaagatcgatctggaggaccctcgacagctcaagttcattcctgaggcgtccagagcgtgcactctgtgtctgtcatacattagtgcgccggcatgtacgccatgtggacactttttctgttgggactgtatttccgaatgggtgagagagaagcccgagtgtcccttgtgtcggcagggtgtgagagagcagaacttgttgcctatcagataatgacgaggtctggatggaaggactagtcagcgagacacagagcatcagggaccagacacgaccaattcaatcgacaacactgtgctgcatagcagtgcacagaggtcctgggcatgaatatattttagcattggagatatgagtggtagagcgtatacagtattaattgtggaggtatctcgtcgcattgatagagcaatacagttactgctgaagc

SEQ ID NO: 158 - DNA, 7966 bp, Artificial Sequence
  Plasmid pYPS161
aaatgtaacgaaactgaaatttgaccagatattgtgtccgcggtggagctccagcttttgttccctttagtgagggttaatttcgagcttggcgtaatcatggtcatagctgtttcctgtgtgaaattgttatccgctcacaagcttccacacaacgtacgttctggttggctcggatgatttctgcggccccagcgtaaggcaggcgttccgtccggatcggtttgggtcggatcggctttttgattgtcgtattgtcgctcatgttggacctggtgtgtagttgtagtgtcagatcagattcaccagcgaatgcatgtgaacttccccacattttgagccgaggcagatttgggttgcttagtaagcagacgtggcgttgcaagtagatgtggcaaatggggacgaagattccgaggggatatcatagttccaaggggatgtcatcatttgccagctttcgccgccacttttgacgagtttttgtgggtcaaataagtttagttgaacttttcaaatttcagttggcattttgttaatagaaagggtgccggtgctggggggttcattcctcgggttgcagatatcctatctgtcttaggggtatctctttcaatcgacaagatgtagttgggtaacaattatttattaatattctctccatccagtacagtactaacatcttgacatctcagcacaagtgcatcttcccaagtgtttgttggagaggttgttgggtattacttaggaaacagaacacagtacgtggagatcttggatacatcgtacatggaggttatccataaaaaagaccctccaggactagttacaatgccgttagatgaggaaatccacaaccctgattcactatgaacatattatcttcccccaaacttgcgatatatggcccttgatgatagccttgattttacccttgatggtacctccacgaccaaccgatctgctgtttgaagagatattttcaaatttgaagtgctcagatctactaaacatgagtccagtaattctttccgtctttccgatttccgatattcccttttttagcccgacttttcactgctcccatgtcaaacgattaggacttgggagacaatcccactgtcaaaatcaccccgatattctctgtaaaacaagtacttcttccacgtgatcttcaaatacctcttccacgtgaccttcaaatacctcttcaagtacctcttccacgcgaccttcaaagtcccttcaaatacccttctcaattctccccttctcctccatagtccttctctctgactaagcttgagaatacatgacgctaagacgaaaacacactagagaccctgagagcctgaacatgcatccactctgcagttgcgcacgtgcctacagcaactatcgggtccagtgctggatctgacactgcgtctccctatgaagaaactgataaacagatctgcactcataacaatgatctgagcgatgaaaacgtgacctccacagccacaagtcataatcggcgcgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgatgcggtgtgaaataccgcacagatgcgtaaggagaaaataccgcatcaggaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgggcccgacgtcgcatgcaactattagtgaggcttcgggagtggttgtctcggttgtctcattcagactcgttgtgttgtatctatatctatataaacactcttgtccctcaatcccactgccatcttttgctaaacttgccgccaatatgaaactcatctccctcatcaccgtcgctaccaccgctctggcggctgtcggagacaagtacaagctgacctataccagatcagacgcccaatcggtcgaatctctgcccgtcacctaccaagatgacctgatcaccgcctccaccgacggcgaacccatcaccatcaccgagggcgagggcaacaccttctctgttaacgacatgcccatcgcctatctggagctgcaggctttgttctggaccggcgactacggctacaagctccagggctcggtctttgacattgccgccgatggaacctttgagctgagagacggccccaaggagtactactattgcactcctcaccctgagcgaaacgtcatctacgtcatcaacagccccgactactccaagtgtcggttcaagcgtaccatcaagttccacgctgaaaagatctaagtggtaatcgaccgactaaccatttttagctgacaaacacttgctaactcctataacgaatgaatgactaacttggcatattgttaccaagtattacttgggatatagttgagtgtaaccattgctaagaatccaaactggagcttctaaaggtctgggagtcgccgtatgtgttcatatcgaaatcaaagaaatcataatcgcaacagaattcaaaatcaagcagattaatatccattattgtactcggatcgtgacatatctgatatgatctcggatatgatctctgactgtttactgggagatttgttgaagatttgttgaggttatctgaaaagtagacaatagagacaaaatgacgatatcaagaactgaatcgggccgaaatactcggtatcattcccttcagcagtaactgtattgctctatcaatgcgacgagatacctccacaattaatactgtatacgctctaccactcatatctccaatgctaaaatatattcatgcccaggacctctgtgcactgctatgcagcacagtgttgtcgattgaattggtcgtgtctggtccctgatgctctgtgtctcgctgactagtccttccatccagacctcgtcattatctgataggcaacaagttctgctctctcacaccctgccgacacaagggacactcgggcttctctctcacccattcggaaatacagtccttaattaagttgcgacacatgtcttgatagtatcttgaattctctctcttgagcttttccataacaagttcttctgcctccaggaagtccatgggtggtttgatcatggttttggtgtagtggtagtgcagtggtggtattgtgactggggatgtagttgagaataagtcatacacaagtcagctttcttcgagcctcatataagtataagtagttcaacgtattagcactgtacccagcatctccgtatcgagaaacacaacaacatgccccattggacagatcatgcggatacacaggttgtgcagtatcatacatactcgatcagacaggtcgtctgaccatcatacaagctgaacaagcgctccatacttgcacgctctctatatacacagttaaattacatatccatagtctaacctctaacagttaatcttctggtaagcctcccagccagccttctggtatcgcttggcctcctcaataggatctcggttctggccgtacagacctcggccgacaattatgatatccgttccggtagacatgacatcctcaacagttcggtactgctgtccgagagcgtctcccttgtcgtcaagacccaccccgggggtcagaataagccagtcctcagagtcgcccttaggtcggttctgggcaatgaagccaaccacaaactcggggtcggatcgggcaagctcaatggtctgcttggagtactcgccagtggccagagagcccttgcaagacagctcggccagcatgagcagacctctggccagcttctcgttgggagaggggactaggaactccttgtactgggagttctcgtagtcagagacgtcctccttcttctgttcagagacagtttcctcggcaccagctcgcaggccagcaatgattccggttccgggtacaccgtgggcgttggtgatatcggaccactcggcgattcggtgacaccggtactggtgcttgacagtgttgccaatatctgcgaactttctgtcctcgaacaggaagaaaccgtgcttaagagcaagttccttgagggggagcacagtgccggcgtaggtgaagtcgtcaatgatgtcgatatgggttttgatcatgcacacataaggtccgaccttatcggcaagctcaatgagctccttggtggtggtaacatccagagaagcacacaggttggttttcttggctgccacgagcttgagcactcgagcggcaaaggcggacttgtggacgttagctcgagcttcgtaggagggcattttggtggtgaagaggagactgaaataaatttagtctgcagaactttttatcggaaccttatctggggcagtgaagtatatgttatggtaatagttacgagttagttgaacttatagatagactggactatacggctatcggtccaaattagaaagaacgtcaatggctctctgggcgtcgcctttgccgacaaaaatgtgatcatgatgaaagccagcaatgacgttgcagctgatattgttgtcggccaaccgcgccgaaaacgcagctgtcagacccacagcctccaacgaagaatgtatcgtcaaagtgatccaagcacactcatagttggagtcgtactccaaaggcggcaatgacgagtcagacagatactcgtcgaccttttccttgggaaccaccaccgtcagcccttctgactcacgtattgtagccaccgacacaggcaacagtccgtggatagcagaatatgtcttgtcggtccatttctcaccaactttaggcgtcaagtgaatgttgcagaagaagtatgtgccttcattgagaatcggtgttgctgatttcaataaagtcttgagatcagtttggccagtcatgttgtggggggtaattggattgagttatcgcctacagtctgtacaggtatactcgctgcccactttatactttttgattccgctgcacttgaagcaatgtcgtttaccaaaagtgagaatgctccacagaacacaccccagggtatggttgagcaaaaaataaacactccgatacggggaatcgaaccccggtctccacggttctcaagaagtattcttgatgagagcgtatcgatgagcctaaaatgaacccgagtatatctcataaaattctcggtgagaggtctgtgactgtcagtacaaggtgccttcattatgccctcaaccttaccatacctcactgaatgtagtgtacctctaaaaatgaaatacagtgccaaaagccaaggcactgagctcgtctaacggacttgatatacaaccaattaaaacaaatgaaaagaaatacagttctttgtatcatttgtaacaattaccctgtacaaactaaggtattgaaatcccacaatattcccaaagtccacccctttccaaattgtcatgcctacaactcatataccaagcactaacctaccgttt

SEQ ID NO: 159 - DNA, 20 bp, Artificial Sequence
  Primer Pex-10del1 3'.Forward
ccaacatgagcgacaatacg

SEQ ID NO: 160 - DNA, 20 bp, Artificial Sequence
  Primer Pex-10del2 5'.Reverse
caagttctgctctctcacac

SEQ ID NO: 161 - DNA, 23 bp, Artificial Sequence
  Primer KL2-3-1
ctcgaggattcattcgagccatg

SEQ ID NO: 162 - DNA, 22 bp, Artificial Sequence
  Primer KL2-3-2
cgagggagctggatggtccaag

SEQ ID NO: 163 - DNA, 24 bp, Artificial Sequence
  Primer SCP-5-2
atgtctctcaaggtcgacggcttc

SEQ ID NO: 164 - DNA, 22 bp, Artificial Sequence
  Primer KD2-5-3
gtgacttgtctgttgcctgttg

SEQ ID NO: 165 - DNA, 22 bp, Artificial Sequence
  Primer 79-5-POX-1
gccatcaccgtcggagagacag

SEQ ID NO: 166 - DNA, 22 bp, Artificial Sequence
  Primer 79-5-POX-2
cgttgctgcacgtggaattttc

SEQ ID NO: 167 - DNA, 20 bp, Artificial Sequence
  Primer 4305ZP3-3-2
gttagtgaagtcttttatag

SEQ ID NO: 168 - DNA, 23 bp, Artificial Sequence
  Primer 79-3-POX-3
gtagggcaagagatgacaaaaag

SEQ ID NO: 169 - DNA, 22 bp, Artificial Sequence
  Primer KL2-5-2
gtacgttatcatttgaacagtg

SEQ ID NO: 170 - DNA, 22 bp, Artificial Sequence
  Primer KL2-5-3
ctcacaccatcctcattcaaag

SEQ ID NO: 171 - DNA, 22 bp, Artificial Sequence
  Primer KL2-3-2
gactctgtgattgagcagtatc

SEQ ID NO: 172 - DNA, 22 bp, Artificial Sequence
  Primer KL2-3-3
ctggtgaggtctttattgactg

SEQ ID NO: 173 - DNA, 844 bp, Artificial Sequence
  chimeric fragment comprising DNA from chromosome E, unknown DNA and 5'-end of pZKD2-5U89A2
  misc_feature (797)..(797): n is a, c, g, or t
gtgacttgtctgttggctgttgttagaagaaaaagtgggagcttatcagtcacggtccacgaacgatttcgtacttgtacgtaattggtcgtgagaactgttgcagagccggtgcttttttttgtggccaagtcgacaggtcgatttcggcgctgtgcgaggttgctgggatgtgctggtttggctaccaaatgtggggaagatttcaacctcggatttgacgtgtgtagagggcataacacattattatagacgtgtctctctcctttcctaagggatcttagagggatcttagaataccgcagtactgttccttttccactcaaagcgggtctccagaacagccagggataaaataacactatgattaacttgaaacgatctcatccacatcatcaaattggctgagccagccttgaataaaagctgatatgctgagaagttgacactcaacttgccagtataaagttatttcttatttgcttaacatcagtgtgtgaatgaaggccagatccagagttttcaataacaaagaagacttgttgcccttgccgacgtcaccgtcgttcttgaggtcaaggtaccaagactcggtcttgccagccttgttcttgaggttgaagacaatgatagcgttggccttcttgatggactcagccttctgcttggcctgagaggggtcgttaagaccgtcacggatgacgtcgaagatgatagaagaagtgaagccgtcgaccttgagagacattgttgtttttgtgtaatgaataagagatattctgggagctaaaccggangatgcaccctacctatatatatgtcgttagattgactatatgcattt

SEQ ID NO: 174 - DNA, 303 bp, Artificial Sequence
  unknown DNA between the 5'-end of pZKD2-5U89A2 and chromosome E
gcataacacattattatagacgtgtctctctcctttcctaagggatcttagagggatcttagaataccgcagtactgttccttttccactcaaagcgggtctccagaacagccagggataaaataacactatgattaacttgaaacgatctcatccacatcatcaaattggctgagccagccttgaataaaagctgatatgctgagaagttgacactcaacttgccagtataaagttatttcttatttgcttaacatcagtgtgtgaatgaaggccagatccagagttttcaataacaaagaa

SEQ ID NO: 175 - DNA, 2365 bp, Artificial Sequence
  chimeric fragment comprising chromosome F, unknown DNA and 5'-end of pZP3-PA777U
  misc_feature (1403)..(1403): n is a, c, g, or t
  misc_feature (1439)..(1439): n is a, c, g, or t
  misc_feature (1686)..(1686): n is a, c, g, or t
cgttgctgcacgtggaattttcggccgaaaacctgtggggtacttacttttggcactggagagaagcatctgggattttgggaacctaggcagaagatgaggaaaaaaataagaggaaccgttgtgagcttgcttatcagtgtcatatactcccccctccttgcgtttttgcgtcttttccccctatttttccgattttgcgattttttttctctttttttccgcttttttccgctttttttttggccggcttttatccatttctccaagccgaggatcacatctatgcagcccagtccgttggagcatatctgcggtagagtttcggaacggcgttaagcactgtgtccgggtcggtctggaacgatattgagcgggaaattcgggggaataagaccaccgttggactccccgcaatgaggagatcaagatgtgcttttcacaattctgattggtggcgctctatttttgatcctgtgtgggattattcaccctgtatgttgggttgactgtgttgttttgattgccggagaattaaactgtcgaatcacttaacctgctctctgcgcctgattccaaccaccttgagaatacgtgacagtaaggcagacattttataccgtactctaatacgttatttagttgtattgttaggcagacattttataccatactctaaatgttatttagttgtagtgtttagcagacattttataccatactataatatgttatttagttgcagtgttttgcagacattttatacaatactataatacgttatttagttgtagtgtttgtgccaggggcctctatggcctccatcaggcgggctcctgcatcccgtgtctctgctcgcctgacgggaccgtacctgggtctgtgtgtgacccagagactggacagtgtgtgtgtaaggtgagtgtgtgagaatatgtttactgacatctattactgataattatcttatctactagtcattttttatatatcacttaggaaaacactgagggacctcgctgcgactcgtgccgccgtggttaccacagcctggagaggaggaactccttggggtgtctggcgtgtgcgtgtgacgtccgcggcaccctgaaggggggtgtgtgtgaccccgtcaactcccagtgtccctgtagggagggagtggagggtgcccagtgtacacgctgctccctacactactacaacacaacctctgaactctacgatgacctcacacctgacccctactacaacatgacctttgacccccaggggtcatcccagggatgtgttccgtgtgtgtgtgaccccacgggaacagtggagggggcgatgtgtgacgcggacaccgggcagtgtgtgtgtgtgcccacgcgccacggaagggattgcggtagatgtangccaggtgagtgtgtgtgtgtgtgtgtgtccactcnccatggaagggactgcggtagatgtaggccaggtaagtgtgtgtgtgtgtgtgtgtgtgtgtgtgtgtgtgtgtgtgtgcttatgtttgttcataaatctacccaactggtttgcaatgggtagaagtgcttagcaacagaatgttctcttactcacacctttaactctgtggacagaatgtttgtgtttatctctcttactcacacctttaactctgtggacagaatgtttgtggtttatctctcnttactcacacctttaactctgtaggagaagatatgtatatgacagtaatactttatacttactgttgaataagtatcgacgcacacaactcccagctcattacactgaagcatctcagctctggcattgacgacaagctgccatgctgtttaccacaatgctcaacacactcctctttcactccctttgttcctgtctctctctttcaaatcacaccctcggtctgttcttttctctcggtctgatggatggatggtccctgtagtgtgtctttttgtttcttggctcctggcggtgttgtcgtgtgcctgcgtatgtgtgcgtatgtgtgtgtatgtgtgtatatgtgtgtgtatgtgtttgtgtgtgcgtgtgtatgcgtgtgtgtgtgtgtgtgtatgcatgtgtgtgtgcgtatgcatgtgtatgtgtgtgtgcctatttgtgtgtgtgtctgtgctttgtcctggggaatgatgatgagtgcttggcattcactgtccggctggagccacccaaaagcagaaaaacgaaaaacctaggctcagtgtgtggtgtggaaagaaatggcgcactagtgggcagcacagatagccatcgagaacagcaggatatccccctgtgtgtcgcggacccgtcccagaccagcccgggccgtcgaccacgcgtgccctatagt

SEQ ID NO: 176 - DNA, 1729 bp, Artificial Sequence
  Unknown DNA between the 5'-end of pZP3-PA777U and chromosome F
  misc_feature (947)..(947): n is a, c, g, or t
  misc_feature (983)..(983): n is a, c, g, or t
  misc_feature (1230)..(1230): n is a, c, g, or t
ggcgctctatttttgatcctgtgtgggattattcaccctgtatgttgggttgactgtgttgttttgattgccggagaattaaactgtcgaatcacttaacctgctctctgcgcctgattccaaccaccttgagaatacgtgacagtaaggcagacattttataccgtactctaatacgttatttagttgtattgttaggcagacattttataccatactctaaatgttatttagttgtagtgtttagcagacattttataccatactataatatgttatttagttgcagtgttttgcagacattttatacaatactataatacgttatttagttgtagtgtttgtgccaggggcctctatggcctccatcaggcgggctcctgcatcccgtgtctctgctcgcctgacgggaccgtacctgggtctgtgtgtgacccagagactggacagtgtgtgtgtaaggtgagtgtgtgagaatatgtttactgacatctattactgataattatcttatctactagtcattttttatatatcacttaggaaaacactgagggacctcgctgcgactcgtgccgccgtggttaccacagcctggagaggaggaactccttggggtgtctggcgtgtgcgtgtgacgtccgcggcaccctgaaggggggtgtgtgtgaccccgtcaactcccagtgtccctgtagggagggagtggagggtgcccagtgtacacgctgctccctacactactacaacacaacctctgaactctacgatgacctcacacctgacccctactacaacatgacctttgacccccaggggtcatcccagggatgtgttccgtgtgtgtgtgaccccacgggaacagtggagggggcgatgtgtgacgcggacaccgggcagtgtgtgtgtgtgcccacgcgccacggaagggattgcggtagatgtangccaggtgagtgtgtgtgtgtgtgtgtgtccactcnccatggaagggactgcggtagatgtaggccaggtaagtgtgtgtgtgtgtgtgtgtgtgtgtgtgtgtgtgtgtgtgtgcttatgtttgttcataaatctacccaactggtttgcaatgggtagaagtgcttagcaacagaatgttctcttactcacacctttaactctgtggacagaatgtttgtgtttatctctcttactcacacctttaactctgtggacagaatgtttgtggtttatctctcnttactcacacctttaactctgtaggagaagatatgtatatgacagtaatactttatacttactgttgaataagtatcgacgcacacaactcccagctcattacactgaagcatctcagctctggcattgacgacaagctgccatgctgtttaccacaatgctcaacacactcctctttcactccctttgttcctgtctctctctttcaaatcacaccctcggtctgttcttttctctcggtctgatggatggatggtccctgtagtgtgtctttttgtttcttggctcctggcggtgttgtcgtgtgcctgcgtatgtgtgcgtatgtgtgtgtatgtgtgtatatgtgtgtgtatgtgtttgtgtgtgcgtgtgtatgcgtgtgtgtgtgtgtgtgtatgcatgtgtgtgtgcgtatgcatgtgtatgtgtgtgtgcctatttgtgtgtgtgtctgtgctttgtcctggggaatgatgatgagtgcttggcattcact

SEQ ID NO: 177 - DNA, 326 bp, Artificial Sequence
  chimeric fragment comprising chromosome F and 3'-end of the AscI/PacI fragment of pZP3-PA777U
gttagtgaagtcttttataggcatcagcgcccaattttatccgtgcttgtctcactcccgcattgggtttcattacctgcgcttatccattttgctgtcaaagcaaagtttccaggtgtagagttcgagcttgaaactcaatccaaaacagtggtttttcggctcctgtagcgggaaggcgtcgagatatcgacattgttccatctccagtttaaccccaacttatcgagagtatttgtgagacacgcaataaatgaatttataccaatcaaatccatattctacgctgtctacatatagatactttttgtcatctcttgccctac

SEQ ID NO: 178 - DNA, 519 bp, Artificial Sequence
  Chimeric fragment comprising chromosome C and the 5'-end of the AscI/SphI fragment of pZKL2-5U89GC
ctcacaccatcctcattcaaagcgttacactgattacgcgcccatcaacgacagcatgaggggactgctgatctgatctaatcaaatgactacaaaaatcgcaataatgaagagcaaacgacaaaaaagaaacaggttaaccaatcccgcttcaatgtctcaccacaatccagcactgtttctcattacctcctccctctaatttcagagttgcatcagggtccttgatttgttctctttggttctgacgagaaattttaatagatgtcttgctgaattattacaattctaacttagtagttctgttagagggcaatttagaggggccttgtggttttgatttacacgaaattgaatagaatggggacaaaaaattgaaagctaggacaactcctgagacacagtccttctctttttataccaaaacccatctcgtacgccctatctcagtgtcttttggtcgacactttaccgcatctatagaccagcccgggccgtcgaccacgcgtgccctatagt

SEQ ID NO: 179 - DNA, 66 bp, Artificial Sequence
  unknown DNA at the junction of chromosome C and 5'-end of the AscI/SphI fragment of pZKL2-5U89GC
ttgttctctttggttctgacgagaaattttaatagatgtcttgctgaattattacaattctaactt

SEQ ID NO: 180 - DNA, 711 bp, Artificial Sequence
  fragment containing DNA from chromosome C and the 3'-end of the AscI/SphI fragment of pZKL2-5U89GC
ctggtgaggtctttattgactggcccctgatccaccctcctctctccaacgttgtcatgtgccagggccagagcaataaacagtgctctgccggtaacactctgctccagcaggtcaatgtgattggaaaccatctgcagtacttcgtcaccgagggtgtctgtggtatctaagctatttatcactctttacaacttctacctcaactatctactttaataaatgaatatcgtttattctctatgattactgtatatgcgttcctctaaactaaacaacacagctaaacaacacagctaaacaacacagctaaacaacacagctaacacatgcatctactacaactaagttgttcatcatcaactttcatctttcaacacgatacaccacacaacatgtccacgcgagacaccttttacgggtggtatttgtgagtacaacacggcgaacacacggtctaccgcagactatctacgctccgctccctgctaacatagtgccatccactttgtcatcaccctgatggtcgatggaggctttgccattcctgcggcgtacaaactacccgggcaacagttcatggaagacttccacgtggcatccaacaaggatttcattgtgctcgaaaaaccagcgtggttcatgtccttcatctggatcgagatcctcttccagaccagcccgggccgtcgaccacgcgtgccctatagt

SEQ ID NO: 181 - DNA, 65 bp, Artificial Sequence
  unknown DNA at the junction of chromosome C and the 3'-end of the AscI/SphI fragment of pZKL2-5U89GC
ctaaactaaacaacacagctaaacaacacagctaaacaacacagctaaacaacacagctaacaca

SEQ ID NO: 182 - protein, 4 aa, Artificial Sequence
  HPGG motif
HPGG

SEQ ID NO: 183 - protein, 4 aa, Artificial Sequence
  HXGG motif
  misc_feature (2)..(2): Xaa can be any naturally occurring amino acid
HXGG

SEQ ID NO: 184 - protein, 4 aa, Artificial Sequence
  HPGX motif
  misc_feature (4)..(4): Xaa can be any naturally occurring amino acid
HPGX

SEQ ID NO: 185 - protein, 4 aa, Artificial Sequence
  HGGG motif
HGGG

SEQ ID NO: 186 - protein, 4 aa, Artificial Sequence
  HHGG motif
HHGG

SEQ ID NO: 187 - protein, 4 aa, Artificial Sequence
  HPGS motif
HPGS

SEQ ID NO: 188 - protein, 4 aa, Artificial Sequence
  HCGG motif
HCGG

SEQ ID NO: 189 - protein, 4 aa, Artificial Sequence
  HWGG motif
HWGG

SEQ ID NO: 190 - protein, 5 aa, Artificial Sequence
  His-rich motif
  misc_feature (2)..(4): Xaa can be any naturally occurring amino acid
HXXXH

SEQ ID NO: 191 - protein, 6 aa, Artificial Sequence
  His-rich motif
  misc_feature (2)..(5): Xaa can be any naturally occurring amino acid
HXXXXH

SEQ ID NO: 192 - protein, 5 aa, Artificial Sequence
  His-rich motif
  misc_feature (2)..(3): Xaa can be any naturally occurring amino acid
HXXHH

SEQ ID NO: 193 - protein, 6 aa, Artificial Sequence
  His-rich motif
  misc_feature (2)..(4): Xaa can be any naturally occurring amino acid
HXXXHH

SEQ ID NO: 194 - protein, 5 aa, Artificial Sequence
  His-rich motif
  MISC_FEATURE (1)..(1): Xaa = His [H] or Gln [Q]
  misc_feature (2)..(3): Xaa can be any naturally occurring amino acid
XXXHH

SEQ ID NO: 195 - protein, 6 aa, Artificial Sequence
  His-rich motif
  MISC_FEATURE (1)..(1): Xaa = His [H] or Gln [Q]
  misc_feature (2)..(4): Xaa can be any naturally occurring amino acid
XXXXHH

SEQ ID NO: 196 - DNA, 1350 bp, Euglena gracilis
  misc_feature (1)..(1350): synthetic mutant delta-5 desaturase
atggctctctcccttactaccgagcagctgctcgagcgacccgacctggttgccatcgacggcattctctacgatctggaaggtcttgccaaggtccatggtggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 197 - DNA, 1350 bp, Euglena gracilis
  misc_feature (1)..(1350): synthetic mutant delta-5 desaturase
atggctctctcccttactaccgagcagctgctcgagcgacccgacctggttgccatcgacggcattctctacgatctggaaggtcttgccaaggtccatcacggaggcgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 198 - DNA, 1350 bp, Euglena gracilis
  misc_feature (1)..(1350): synthetic mutant delta-5 desaturase
atggctctctcccttactaccgagcagctgctcgagcgacccgacctggttgccatcgacggcattctctacgatctggaaggtcttgccaaggtccatcccggatccgacttgatcctcgcttctggtgcctccgatgcttctcctctgttctactccatgcacccttacgtcaagcccgagaactcgaagctgcttcaacagttcgtgcgaggcaagcacgaccgaacctccaaggacattgtctacacctacgactctccctttgcacaggacgtcaagcgaactatgcgagaggtcatgaaaggtcggaactggtatgccacacctggattctggctgcgaaccgttggcatcattgctgtcaccgccttttgcgagtggcactgggctactaccggaatggtgctgtggggtctcttgactggattcatgcacatgcagatcggcctgtccattcagcacgatgcctctcatggtgccatcagcaaaaagccctgggtcaacgctctctttgcctacggcatcgacgtcattggatcgtccagatggatctggctgcagtctcacatcatgcgacatcacacctacaccaatcagcatggtctcgacctggatgccgagtccgcagaaccattccttgtgttccacaactaccctgctgccaacactgctcgaaagtggtttcaccgattccaggcctggtacatgtacctcgtgcttggagcctacggcgtttcgctggtgtacaaccctctctacatcttccgaatgcagcacaacgacaccattcccgagtctgtcacagccatgcgagagaacggctttctgcgacggtaccgaacccttgcattcgttatgcgagctttcttcatctttcgaaccgccttcttgccctggtatctcactggaacctccctgctcatcaccattcctctggtgcccactgctaccggtgccttcctcaccttctttttcatcttgtctcacaacttcgatggctcggagcgaatccccgacaagaactgcaaggtcaagagctccgagaaggacgttgaagccgatcagatcgactggtacagagctcaggtggagacctcttccacctacggtggacccattgccatgttctttactggcggtctcaacttccagatcgagcatcacctctttcctcgaatgtcgtcttggcactatcccttcgtgcagcaagctgtccgagagtgttgcgaacgacacggagttcggtacgtcttctaccctaccattgtgggcaacatcatttccaccctcaagtacatgcacaaagtcggtgtggttcactgtgtcaaggacgctcaggattcctaa

SEQ ID NO: 199 - DNA, 1365 bp, Euglena anabaena UTEX 373
  misc_feature (1)..(1365): synthetic mutant delta-5 desaturase
atggccaccatctccctgactaccgagcagctcctggaacaccccgagctcgttgccatcgacggagtcctgtacgatctcttcggtctggccaaggtgcattgcggaggcaacctcatcgaagctgccggtgcatccgacggaaccgctctgttctactccatgcatcctggagtcaagccagagaactcgaagcttctgcagcaatttgcccgaggcaagcacgaacgaagctccaaggatcccgtgtacaccttcgactctccctttgctcaggacgtcaagcagtccgttcgagaggtcatgaagggtcgaaactggtacgccactcctggcttctggctgagaaccgcactcatcatcgcttgtactgccattggcgagtggtactggatcacaaccggagcagtgatgtggggtatctttactggatacttccactcgcagattggcttggccattcaacacgatgcttctcacggagccatcagcaaaaagccctgggtcaacgcctttttcgcttatggcatcgacgccattggttcctctcgttggatctggctgcagtcccacattatgcgacatcacacttacaccaaccagcatggcctcgacctggatgctgcctcggcagagccgttcatcttgttccactcctatcctgctaccaacgcctctcgaaagtggtaccaccgatttcaggcgtggtacatgtacatcgttctgggaatgtatggtgtctcgatggtgtacaatcccatgtacctcttcacaatgcagcacaacgacaccattcccgaggccacttctctcagaccaggcagctttttcaatcggcagcgagctttcgccgtttcccttcgactgctcttcatcttccgaaacgcctttcttccctggtacattgctggtgcctctcctctgctcaccattcttctggtgcccacggtcacaggcatcttcctcacctttgtgttcgttctgtcccataacttcgagggagccgaacggaccccagagaagaactgcaaggccaaacgagctaaggaaggcaaggaggtcagagacgtggaagaggatcgagtcgactggtaccgagcacaggccgagactgctgccacctacggtggcagcgtgggaatgatgcttacaggcggtctcaacctgcagatcgagcatcacttgtttccccgaatgtcctcttggcactatcccttcattcaagacaccgttcgggagtgttgcaagcgacatggcgtccgttacacatactatcctaccattctcgagaacatcatgtccactcttcgatacatgcagaaggtgggtgttgctcacaccattcaggatgcccaggagttctaa

SEQ ID NO: 200 - DNA, 1392 bp, Peridinium sp. CCMP626
  misc_feature (1)..(1392): synthetic mutant delta-5 desaturase
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcactgcggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

SEQ ID NO: 201 - DNA, 1392 bp, Peridinium sp. CCMP626
  misc_feature (1)..(1392): synthetic mutant delta-5 desaturase
atggctcccgacgccgacaagctgcgacagcgaaaggctcagtccatccaggacactgccgattctcaggctaccgagctcaagattggcaccctgaagggtctccaaggcaccgagatcgtcattgatggcgacatctacgacatcaaagacttcgatcactggggaggcgaatccatcatgacctttggtggcaacgacgttactgccacctacaagatgattcatccctaccactcgaagcatcacctggagaagatgaaaaaggtcggtcgagtgcccgactacacctccgagtacaagttcgatactcccttcgaacgagagatcaaacaggaggtcttcaagattgtgcgaagaggtcgagagtttggaacacctggctacttctttcgagccttctgctacatcggtctcttcttttacctgcagtatctctgggttaccactcctaccactttcgcccttgctatcttctacggtgtgtctcaggccttcattggcctgaacgtccagcacgacgccaaccacggagctgcctccaaaaagccctggatcaacaatttgctcggcctgggtgccgactttatcggaggctccaagtggctctggatgaaccagcactggacccatcacacttacaccaaccatcacgagaaggatcccgacgccctgggtgcagagcctatgctgctcttcaacgactatcccttgggtcaccccaagcgaaccctcattcatcacttccaagccttctactatctgtttgtccttgctggctactgggtgtcttcggtgttcaaccctcagatcctggacctccagcaccgaggtgcccaggctgtcggcatgaagatggagaacgactacattgccaagtctcgaaagtacgctatcttcctgcgactcctgtacatctacaccaacattgtggctcccatccagaaccaaggcttttcgctcaccgtcgttgctcacattcttactatgggtgtcgcctccagcctgaccctcgctactctgttcgccctctcccacaacttcgagaacgcagatcgggatcccacctacgaggctcgaaagggaggcgagcctgtctgttggttcaagtcgcaggtggaaacctcctctacttacggtggcttcatttccggttgccttacaggcggactcaactttcaggtcgagcatcacctgtttcctcgaatgtcctctgcctggtacccctacatcgctcctaccgttcgagaggtctgcaaaaagcacggcgtcaagtacgcctactatccctgggtgtggcagaacctcatctcgaccgtcaagtacctgcatcagtccggaactggctcgaactggaagaacggtgccaatccctactctggcaagctgtaa

What is claimed is:

1. A microbial oil comprising:
   a) eicosapentaenoic acid, wherein the weight percent of eicosapentaenoic acid as a weight percent of the total fatty acids is at least 51.1;
   b) less than 0.1 weight percent docosahexaenoic acid as a weight percent of the total fatty acids;
   c) less than 20.9 weight percent of linoleic acid as a weight percent of the total fatty acids, provided that the percentage of linoleic acid is not equal to zero;
   d) less than 6.9 weight percent of oleic acid as a weight percent of the total fatty acids, provided that the percentage of oleic acid is not equal to zero; and
   e) less than 3.1 weight percent of eicosadienoic acid as a weight percent of the total fatty acids, provided that the percentage of eicosadienoic acid is not equal to zero.

2. An oil concentrate derived from the oil of claim 1.

3. The oil concentrate of claim 2 wherein the oil comprises at least 60 weight percent of eicosapentaenoic acid as a weight percent of the total fatty acids.

4. The oil concentrate of claim 2 wherein the oil comprises at least 70 weight percent of eicosapentaenoic acid as a weight percent of the total fatty acids.

* * * * *